US007847159B2

(12) United States Patent
Puzio et al.

(10) Patent No.: US 7,847,159 B2
(45) Date of Patent: Dec. 7, 2010

(54) NUCLEIC ACID SEQUENCES ENCODING PROTEINS ASSOCIATED WITH ABIOTIC STRESS RESPONSE AND PLANT CELLS AND PLANTS WITH INCREASED TOLERANCE TO ENVIRONMENTAL STRESS

(75) Inventors: Piotr Puzio, Berlin (DE); Agnes Chardonnens, Enkhuizen (NL); Amber Shirley, Wake Forest, NC (US); Xi-Qing Wang, Chapel Hill, NC (US); Rodrigo Sarria-Millan, Morrisville, NC (US); Bryan Mckersie, Raleigh, NC (US); Ruoying Chen, Apex, NC (US)

(73) Assignee: BASF Plant Science GmbH, Ludwigshafen (DE)

( * ) Notice: Subject to any disclaimer, the term of this patent is extended or adjusted under 35 U.S.C. 154(b) by 576 days.

(21) Appl. No.: 11/251,208

(22) Filed: Oct. 14, 2005

(65) Prior Publication Data

US 2006/0137043 A1    Jun. 22, 2006

Related U.S. Application Data

(63) Continuation-in-part of application No. PCT/US2004/011888, filed on Apr. 15, 2004.

(30) Foreign Application Priority Data

| Apr. 15, 2003 | (EP) | .................................. 03008080 |
| May 2, 2003 | (EP) | .................................. 03009728 |
| Aug. 1, 2003 | (EP) | .................................. 03016672 |
| Sep. 30, 2003 | (EP) | .................................. 03022225 |

(51) Int. Cl.
*A01H 1/00* (2006.01)
*C07H 21/04* (2006.01)
*C07K 14/395* (2006.01)

(52) U.S. Cl. ........................ 800/295; 435/6; 435/320.1; 435/468; 435/419; 530/350; 536/23.7; 800/278; 800/288; 800/289

(58) Field of Classification Search .................... 435/6, 435/69.1, 468, 419, 252.3, 320.1, 183; 530/370; 536/23.2, 23.6; 800/278, 295
See application file for complete search history.

(56) References Cited

U.S. PATENT DOCUMENTS 6,342,656 B1    1/2002 Bradford et al.
6,501,006 B1 *  12/2002 Ismail et al. ................ 800/289

FOREIGN PATENT DOCUMENTS

EP    1 258 494 A1    11/2002

OTHER PUBLICATIONS

Miller et al., UniProt_13.2, Acc. No. P38337, PNAS, vol. 98, pp. 12902-12907, 2001, see Result 1.*

Miller et al., PNAS, vol. 98, pp. 12902-12907, 2001.*
Coissac, E., et al., "Sequence of a 39411 bp DNA Fragment Covering the Left End of Chromosome VII of *Saccharomyces cerevisiae*", Yeast, 1996, vol. 12, No. 15, pp. 1555-1562.
Dubouzet, J.G., et al., "OsDREB Genes in Rice, *Oryza sativa* L., Encode Transcription Activators that Function in Drought-, High-Salt- and Cold-Responsive Gene Expression", The Plant Journal, 2003, vol. 33, pp. 751-763.
Dunwell, J.M., et al., "Microbial Relatives of the Seed Storage Proteins of Higher Plants: Conservation of Structure and Diversification of Function during Evolution of the Cupin Superfamily", Microbiology and Molecular Biology Review, 2000, vol. 64, No. 1, pp. 153-179.
Peng, L., et al., "Expression of Fission Yeast Genes in Plants for Enhanced Metal and Oxidative Stress Tolerance", Poster Presentation in Annual Meeting of the American Society of Plant Biologists on Plant Biology, Denver, Colorado, USA,, Aug. 3-7, 2002, Plant Biology (Rockville), 2002, vol. 2002, p. 143.
Seki, M., et al., "Monitoring the Expression Profiles of 7000 *Arabidopsis* Genes Under Drought, Cold and High-salinity Stresses Using a Full-Length cDNA Microarray", The Plant Journal, 2002, vol. 31, No. 3, pp. 279-292.
Serrano, R., et al., "Genetic Engineering of Salt and Drought Tolerance with Yeast Regulatory Genes", Scientia Horticulturae, 1999, vol. 78, pp. 261-269.
Xiong, L., et al., "Disease Resistance and Abiotic Stress Tolerance in Rice Are Inversely Modulated by an Abscisic Acid-Inducible Mitogen-Activated Protein Kinase", The Plant Cell, 2003, vol. 15, pp. 745-759.
"*S. cerevisiae* Chromosome VII Reading Frame ORF YGL263w", EMBL Database Accession No. Z72785, May 17, 1996.
"*S. cerevisiae* Left Telomeric Region from Chromosome VII", EMBL Database Accession No. X94357, Jan. 6, 1996.
Johnston, M., et al., "The Nucleotide Sequence of *Saccharomyces cerevisiae* Chromosome XII", Nature, 1997, vol. 387, No. Suppl., pp. 87-90.
"*Saccharomyces cerevisiae* Chromosome XII Cosmid 8084", EMBL Database, Accession No. U19729, Jan. 30, 1995.
Anderson, J. B., et al., "Mode of Selection and Experimental Evolution of Antifungal Drug Resistance in *Saccharomyces cerevisiae*", Genetics, 2003, vol. 163, No. 4, pp. 1287-1298.
"Uncharacterized Protein YLR407W", UniProt Database, Accession No. Q06070, Nov. 1, 1996.

(Continued)

*Primary Examiner*—Phuong T Bui
(74) *Attorney, Agent, or Firm*—Connolly Bove Lodge & Hutz, LLP

(57) ABSTRACT

This invention relates generally to nucleic acid sequences encoding proteins that are associated with abiotic stress responses and abiotic stress tolerance in plants. This invention further relates to transformed plant cells with altered metabolic activity compared to a corresponding non transformed wild type plant cell, wherein the metabolic activity is altered by transformation with a Stress-Related Protein (SRP) coding nucleic acid and results in increased tolerance and/or resistance to an environmental stress as compared to a corresponding non-transformed wild type plant cell.

20 Claims, 1 Drawing Sheet

OTHER PUBLICATIONS

Causton, H. C., et al., "Remodeling of Yeast Genome Expression in Response to Environmental Changes", Molecular Biology of the Cell, 2001, vol. 12, No. 2, pp. 323-337.

Rep, M., et al., "Osmotic Stress-Induced Gene Expression in *Saccharomyces cerevisiae* Requires Msn1p and the Novel Nuclear Factor Hot1p", Molecular and Cellular Biology, 1999, vol. 19, No. 8, pp. 5474-5485.

Rodriguez-Vargas, S., et al., "Gene Expression Analysis of Cold and Freeze Stress in Baker's Yeast", Applied and Environmental Microbiology, 2002, vol. 68, No. 6, pp. 3024-3030.

Murakami, Y., et al., "Analysis of the Nucleotide Sequence of Chromosome VI From *Saccharomyces cerevisiae*", Nature, 1995, vol. 10, pp. 261-268.

"*Saccharomyces cerevisiae* DNA, Chromosome VI, Complete Genome", EMBL Database, Accession No. D50617, May 30, 1995.

Eki, T., et al., "Analysis of a 36.2 kb DNA Sequence Including the Right Telomere of Chromosome VI from *Saccharmyces cerevisiae*", Yeast, 1996, vol. 12, No. 2, pp. 149-167.

"Beta-1,6-Glucan Synthesis-Associated Protein KEG1", UniProt Database, Accession No. P43614, Nov. 1, 1995.

Johnston, M., et al., "Complete Nucleotide Sequence of *Saccharomyces cerevisiae* ChromosomeVIII", Science, 1994, vol. 265, pp. 2077-2082.

"*Saccharomyces cerevisiae* Chromosome VIII Cosmid 8263", EMBL Database, Accession No. U00059, Nov. 21, 1994.

"RecName: Full=Putative Aspartyl Aminopeptidase", UniProt Database, Accession No. P38821, Feb. 1, 1995.

"Sequence 2638 from Patent EP1258494", EMBL Database, Accession No. AX596984, Feb. 14, 2003.

"Sequence 2637 from Patent EP1258494", EMBL Database, Accession No. AX596983, Feb. 14, 2003.

\* cited by examiner (Figure 1)
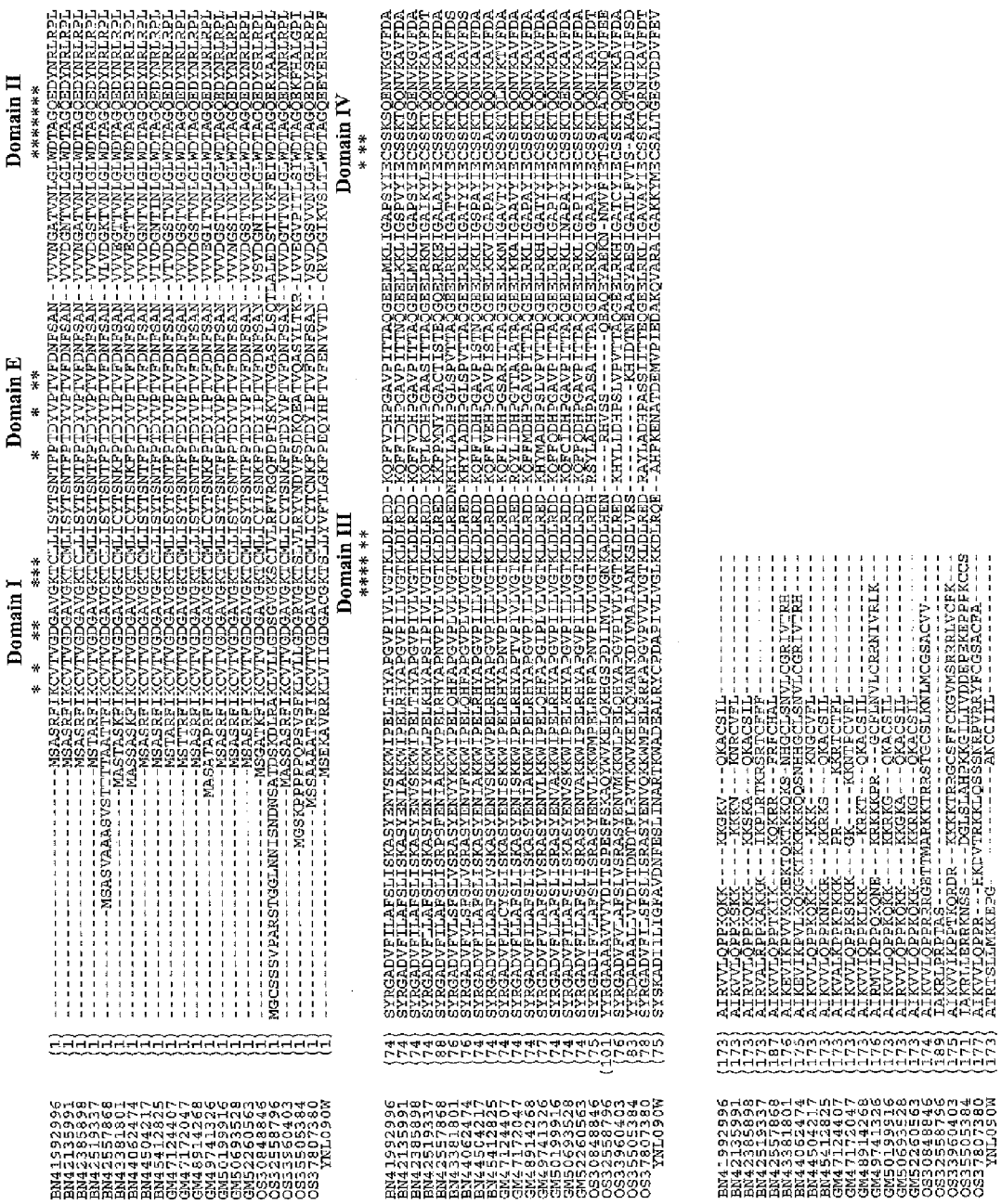

NUCLEIC ACID SEQUENCES ENCODING PROTEINS ASSOCIATED WITH ABIOTIC STRESS RESPONSE AND PLANT CELLS AND PLANTS WITH INCREASED TOLERANCE TO ENVIRONMENTAL STRESS

This application is a continuation-in-part of PCT/US2004/011888 filed Apr. 15, 2004, which claims benefit to European application 03008080.8, filed Apr. 15, 2003, European application 03009728.1, filed May 2, 2003, European application 03016672.2, filed Aug. 1, 2003, and European application 03022225.1, filed. Sep. 30, 2005, which are incorporated by reference in its entirety for all useful purposes.

The contents of the following submission on compact discs are incorporated herein by reference in its entirety: A compact disc copy of the Sequence Listing (COPY 1) (file name: Sequence listing (13311-00015-US), date recorded: Feb. 6, 2006, size: 1.84 MB); a duplicate compact disc copy of the Sequence Listing (COPY 2) (file name: Sequence listing (13311-00015-US), date recorded: Feb. 6, 2006, size: 1.84 MB); a computer readable form copy of the Sequence Listing (CRF COPY) (file name: Sequence listing (13311-00015-US), date recorded: Feb. 6, 2006, size: 1.84 MB).

This invention relates generally to nucleic acid sequences encoding proteins that are associated with abiotic stress responses and abiotic stress tolerance in plants.

This invention further relates to transformed plant cells with altered metabolic activity compared to a corresponding non transformed wild type plant cell, wherein the metabolic activity is altered by transformation with a Stress-Related Protein (SRP) coding nucleic acid and results in increased tolerance and/or resistance to an environmental stress as compared to a corresponding non-transformed wild type plant cell.

In particular, this invention relates to nucleic acid sequences encoding proteins that confer drought, heat, cold, and/or salt tolerance and/or resistance to plants, especially by altering the metabolic activity leading to drought, heat, cold, and/or salt tolerance and/or resistance to plants. The invention also deals with methods of producing, screening for and breeding such plant cells or plants and method of detecting stress in plants cells or plants.

Abiotic environmental stresses such as drought stress, salinity stress, heat stress and cold stress, are major limiting factors of plant growth and productivity (Boyer. 1982. *Science* 218, 443-448). Crop losses and crop yield losses of major crops such as rice, maize (corn) and wheat caused by these stresses represent a significant economic and political factor and contribute to food shortages in many underdeveloped countries.

Plants are typically exposed during their life cycle to conditions of reduced environmental water content. Most plants have evolved strategies to protect themselves against these conditions of low water or desiccation (drought). However, if the severity and duration of the drought conditions are too great, the effects on plant development, growth and yield of most crop plants are profound. Continuous exposure to drought causes major alterations in the plant metabolism. These great changes in metabolism ultimately lead to cell death and consequently yield losses.

Developing stress-tolerant plants is a strategy that has the potential to solve or mediate at least some of these problems (McKersie and Leshem, 1994. *Stress and Stress Coping in Cultivated Plants*, Kluwer Academic Publishers). However, traditional plant breeding strategies to develop new lines of plants that exhibit resistance (tolerance) to these types of stresses are relatively slow and require specific resistant lines for crossing with the desired line. Limited germplasm resources for stress tolerance and incompatibility in crosses between distantly related plant species represent significant problems encountered in conventional breeding. Additionally, the cellular processes leading to drought, cold and salt tolerance are complex in nature and involve multiple mechanisms of cellular adaptation and numerous metabolic pathways (McKersie and Leshem, 1994. *Stress and Stress Coping in Cultivated Plants*, Kluwer Academic Publishers). This multi-component nature of stress tolerance has not only made breeding for tolerance largely unsuccessful, but has also limited the ability to genetically engineer stress tolerance plants using biotechnological methods.

Drought, heat, cold and salt stresses have a common theme important for plant growth and that is water availability. Plants are exposed during their entire life cycle to conditions of reduced environmental water content. Most plants have evolved strategies to protect themselves against these conditions. However, if the severity and duration of the drought conditions are too great, the effects on plant development, growth and yield of most crop plants are profound. Since high salt content in some soils result in less available water for cell intake, its effect is similar to those observed under drought conditions. Additionally, under freezing temperatures, plant cells loose water as a result of ice formation that starts in the apoplast and withdraws water from the symplast (McKersie and Leshem, 1994. *Stress and Stress Coping in Cultivated Plants*, Kluwer Academic Publishers). Commonly, a plant's molecular response mechanisms to each of these stress conditions are similar.

The results of current research indicate that drought tolerance is a complex quantitative trait and that no real diagnostic marker is available yet. High salt concentrations or dehydration may cause damage at the cellular level during drought stress but the precise injury is not entirely clear (Bray, 1997. *Trends Plant Sci.* 2, 48-54). This lack of a mechanistic understanding makes it difficult to design a transgenic approach to improve drought tolerance. However, an important consequence of damage may be the production of reactive oxygen radicals that cause cellular injury, such as lipid peroxidation or protein and nucleic acid modification. Details of oxygen free radical chemistry and their reaction with cellular components such as cell membranes have been described (McKersie and Leshem, 1994. *Stress and Stress Coping in Cultivated Plants*, Kluwer Academic Publishers).

It is the object of this invention to identify new, unique genes capable of conferring stress tolerance to plants upon expression or over-expression.

It is further object of this invention to identify, produce and breed new, unique stress tolerant and/or resistant plant cells or plants and methods of inducing and detecting stress tolerance and/or resistance in plants or plant cells. It is a further object to identify new methods to detect stress tolerance and/or resistance in plants or plant cells. It is also the object of this invention to identify new, unique genes capable of conferring stress tolerance to plants upon expression or over-expression.

DETAILED DESCRIPTION OF THE DRAWING

The drawing shows the protein alignment of Rho small GTPases from *Oryza sativa* cv. Noppon-Brarre (a japonica rice), *Brassica napus* cv. "AC Excel" "Quantum" and "Cresor" (canola), and *Glycine max* cv. Resuick (soybean).

The present invention provides a transformed plant cell with altered metabolic activity compared to a corresponding non transformed wild type plant cell, wherein the metabolic activity is altered by transformation with a Stress-Related Protein (SRP) coding nucleic acid and results in increased tolerance and/or resistance to an environmental stress as compared to a corresponding non-transformed wild type plant cell.

The present invention provides a transgenic plant cell transformed by Stress-Related Protein (SRP) coding nucleic acid selected from the group consisting of:

a) nucleic acid molecule encoding one of the polypeptides shown in FIG. 1a, 1b or 1c or a fragment thereof, which confers an an altered metabolic activity in an organism or a part thereof;

b) nucleic acid molecule comprising one of the nucleic acid molecule shown in FIG. 1a, 1b or 1c;

c) nucleic acid molecule whose sequence can be deduced from a polypeptide sequence encoded by a nucleic acid molecule of (a) or (b) as a result of the degeneracy of the genetic code and conferring an altered metabolic activity in an organism or a part thereof;

d) nucleic acid molecule which encodes a polypeptide which has at least 50% identity with the amino acid sequence of the polypeptide encoded by the nucleic acid molecule of (a) to (c) and conferring an altered metabolic activity in an organism or a part thereof;

e) nucleic acid molecule which hybridizes with a nucleic acid molecule of (a) to (c) under under stringent hybridisation conditions and conferring an altered metabolic activity in an organism or a part thereof;

f) nucleic acid molecule which encompasses a nucleic acid molecule which is obtained by amplifying nucleic acid molecules from a cDNA library or a genomic library using the primers as shown in table 2 and conferring an altered metabolic activity in an organism or a part thereof;

g) nucleic acid molecule encoding a polypeptide which is isolated with the aid of monoclonal antibodies against a polypeptide encoded by one of the nucleic acid molecules of (a) to (f) and conferring an altered metabolic activity in an organism or a part thereof;

h) nucleic acid molecule encoding a polypeptide comprising the consensus sequence shown in FIG. 2 and conferring an altered metabolic activity in an organism or a part thereof; and i) nucleic acid molecule which is obtainable by screening a suitable nucleic acid library under stringent hybridization conditions with a probe comprising one of the sequences of the nucleic acid molecule of (a) to (h) or with a fragment thereof having at least 15 nt, preferably 20 nt, 30 nt, 50 nt, 100 nt, 200 nt or 500 nt of the nucleic acid molecule characterized in (a) to (h) and conferring an altered metabolic activity in an organism or a part thereof.

or comprising a sequence which is complementary thereto.

For the purpose of the present invention the term "FIG. 1a, 1b or 1c" involves and means the SEQ ID NO: 1 to 556 and the term "consensus sequence shown in FIG. 2" means SEQ ID NO: 557 to 560.

Particulary, the term "FIG. 1a" means SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269 and/or 270, the term "FIG. 1b" means SEQ ID NO: 271, 272, 273, 274, 275, 276, 277, 278, 279, 280, 281, 282, 283, 284, 285, 286, 287, 288, 289 and/or 290, the term "FIG. 1c" means SEQ ID NO: 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555 and/or 556, and the term "consensus sequence shown in FIG. 2" means SEQ ID NO: 557, 558, 559 and/or 560.

More precisely, when "polypeptides or proteins according to FIG. 1a" are mentioned, then the SEQ ID NO 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268 and/or 270 are meant;

when "polypeptides or proteins according to FIG. 1b" are mentioned, then the SEQ ID NO 272, 274, 276, 278, 280, 282, 284, 286, 288 and/or 290 are meant;

when "polypeptides or proteins according to FIG. 1c" are mentioned, then the SEQ ID NO 292, 294, 296, 298, 300, 302, 304, 306, 308, 310, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 526, 528, 530, 532, 534, 536, 538, 540, 542, 544, 546, 548, 550, 552, 554 and/or 556 are meant. More precisely, when "polynucleotides or nucleic acid molecules according to FIG. 1a" are mentioned, then the SEQ ID NO 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267 and/or 269 are meant;

when "polynucleotides or nucleic acid molecules according to FIG. 1b" are mentioned; then the SEQ ID NO 271, 273, 275, 277, 279, 281, 283, 285, 287 and/or 289 are meant;

when "polynucleotides or nucleic acid molecules according to FIG. 1c" are mentioned, then the SEQ ID NO 291, 293, 295, 297, 299, 301, 303, 305, 307, 309, 311, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 525, 527, 529, 531, 533, 535, 537, 539, 541, 543, 545, 547, 549, 551, 553 and/or 555 are meant.

As used herein, the term "metabolite" refers to intermediate substances, preferably such of low molecular weight, which occur during anabolism and catabolism in a cell or plant, in other words a substance produced or concumed by metabolism.

The term "altered metabolic activity" refers to the change (increase oe decrease) of the amount, concentration or activity (meaning here the effective concentration for the purposes of chemical reactions and other mass action) of a metabolite in a specific volume relative to a corresponding volume (e.g. in an organism, a tissue, a cell or a cell compartment) of a control, reference or wild type, including the de novo creation of the activity or expression, measured for example by one of the methods described herein below, which is changed (increased or decreased) as compared to a corresponding non transformed wild type plant cell.

The terms "increased", "rised", "extended", "enhanced", "improved" or "amplified" relate to a corresponding change of a property in an organism, a part of an organism such as a tissue, seed, root, leave, flower etc. or in a cell and are interchangeable. Preferably, the overall activity in the volume is increased or enhanced in cases if the increase or enhancement is related to the increase or enhancement of an activity of a gene product, independent whether the amount of gene product or the specific activity of the gene product or both is increased or enhanced or whether the amount, stability or translation efficacy of the nucleic acid sequence or gene encoding for the gene product is increased or enhanced. The terms "reduction", "decrease" or "deletion" relate to a corresponding change of a property in an organism, a part of an organism such as a tissue, seed, root, leave, flower etc. or in a cell. Preferably, the overall activity in the volume is reduced, decreased or deleted in cases if the reduction, decrease or deletion is related to the reduction, decrease or deletion of an activity of a gene product, independent whether the amount of gene product or the specific activity of the gene product or both is reduced, decreased or deleted or whether the amount, stability or translation efficacy of the nucleic acid sequence or gene encoding for the gene product is reduced, decreased or deleted.

The terms "increase" or "decrease" relate to a corresponding change of a property in an organism or in a part of an organism, such as a tissue, seed, root, leave, flower etc. or in a cell. Preferably, the overall activity in the volume is increased in cases the increase relates to the increase of an activity of a gene product, independent whether the amount of gene product or the specific activity of the gene product or both is increased or generated or whether the amount, stability or translation efficacy of the nucleic acid sequence or gene encoding for the gene product is increased.

Under "change of a property" it is understood that the activity, expression level or amount of a gene product or the metabolite content is changed in a specific volume relative to a corresponding volume of a control, reference or wild type, including the de novo creation of the activity or expression.

The terms "increase" or "decrease" include the change of said property in only parts of the subject of the present invention, for example, the modification can be found in compartment of a cell, like a organelle, or in a part of a plant, like tissue, seed, root, leave, flower etc. but is not detectable if the overall subject, i.e. complete cell or plant, is tested. Preferably, the increase or decrease is found cellular, thus the term "increase of an acitivity" or "increase of a metabolite content" relates to the cellular increase compared to the wild typ cell.

Accordingly, the term "increase" or "decrease" means that the specific activity of an enzyme as well as the amount of a compound or metabolite, e.g. of a polypeptide, a nucleic acid molelcule or of the fine chemical of the invention or an encoding mRNA or DNA, can be increased or decreased in a volume.

The terms "wild type", "control" or "reference" are exchangeable and can be a cell or a part of organisms such as an organelle or a tissue, or an organism, in particular a microorganism or a plant, which was not modified or treated according to the herein described process according to the invention. Accordingly, the cell or a part of organisms such as an organelle or a tissue, or an organism, in particular a microorganism or a plant used as wild typ, control or reference corresponds to the cell, organism or part thereof as much as possible and is in any other property but in the result of the process of the invention as identical to the subject matter of the invention as possible. Thus, the wild type, control or reference is treated identically or as identical as possible, saying that only conditions or properties might be different which do not influence the quality of the tested property.

Preferably, any comparison is carried out under analogous conditions. The term "analogous conditions" means that all conditions such as, for example, culture or growing conditions, assay conditions (such as buffer composition, temperature, substrates, pathogen strain, concentrations and the like) are kept identical between the experiments to be compared.

The "reference", "control", or "wild type" is preferably a subject, e.g. an organelle, a cell, a tissue, an organism, in particular a plant or a microorganism, which was not modified or treated according to the herein described process of the invention and is in any other property as similar to the subject matter of the invention as possible. The reference, control or wild type is in its genome, transcriptome, proteome or metabolome as similar as possible to the subject of the present invention. Preferably, the term "reference-" "control-" or "wild type-"-organelle, -cell, -tissue or -organism, in particular plant or microorganism, relates to an organelle, cell, tissue or organism, in particular plant or micororganism, which is nearly genetically identical to the organelle, cell, tissue or organism, in particular microorganism or plant, of the present invention or a part thereof preferably 95%, more preferred are 98%, even more preferred are 99.00%, in particular 99.10%, 99.30%, 99.50%, 99.70%, 99.90%, 99.99%, 99.999% or more. Most preferable the "reference", "control", or "wild type" is a subject, e.g. an organelle, a cell, a tissue, an organism, which is genetically identical to the organism, cell or organelle used according to the process of the invention except that the responsible or acvitivity conferring nucleic acid molecules or the gene product encoded by them are amended, manipulated, exchanged or introduced according to the inventive process.

Preferably, the reference, control or wild type differs form the subject of the present invention only in the cellular activity of the polypeptide of the invention, e.g. as result of an increase in the level of the nucleic acid molecule of the present invention or an increase of the specific activity of the polypeptide of the invention, e.g. by or in the expression level or activity of an protein having the activity of an Stress-Related Protein (SRP) or its homologs, its biochemical or genetical causes and the altered metabolic activity.

In case, a control, reference or wild type differing from the subject of the present invention only by not being subject of the process of the invention can not be provided, a control, reference or wild type can be an organism in which the cause for the modulation of an activity conferring the altered metabolic activity or expression of the nucleic acid molecule of the invention as described herein has been switched back or off, e.g. by knocking out the expression of responsible gene product, e.g. by antisense inhibition, by inactivation of an activator or agonist, by activation of an inhibitor or antagonist, by inhibition through adding inhibitory antibodies, by adding active compounds as e.g. hormones, by introducing negative dominant mutants, etc. A gene production can for example be knocked out by introducing inactivating point mutations, which lead to an enzymatic activity inhibition or a destabilization or an inhibition of the ability to bind to cofactors etc.

Accordingly, preferred reference subject is the starting subject of the present process of the invention. Preferably, the reference and the subject matter of the invention are compared after standardization and normalization, e.g. to the amount of total RNA, DNA, or protein or activity or expression of reference genes, like housekeeping genes, such as ubiquitin, actin or ribosomal proteins.

A series of mechanisms exists via which a modification of the a protein, e.g. the polypeptide of the invention can directly or indirectly affect the yield, production and/or production efficiency of the amino acid.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein. However, it is also possible to increase the expression of the gene which is naturally present in the organisms, for example by modifying the regulation of the gene, or by increasing the stability of the corresponding mRNA or of the corresponding gene product encoded by the nucleic acid molecule of the invention, or by introducing homologous genes from other organisms which are differently regulated, eg. not feedback sensitive.

This also applies analogously to the combined increased expression of the nucleic acid molecule of the present invention or its gene product with that of further enzymes of the amino acid biosynthesis pathways, e.g. which are useful for the synthesis of the fine chemicals.

The increase, decrease or modulation according to this invention can be constitutive, e.g. due to a stable permanent transgenic expression or to a stable mutation in the corresponding endogenous gene encoding the nucleic acid molecule of the invention or to a modulation of the expression or of the behaviour of a gene conferring the expression of the polypeptide of the invention, or transient, e.g. due to an transient transformation or temporary addition of a modulator such as a agonist or antagonist or inducible, e.g. after transformation with a inducible construct carrying the nucleic acid molecule of the invention under control of a induceable promoter and adding the inducer, e.g. tetracycline or as described herein below.

The increase in activity of the polypeptide amounts in a cell, a tissue, a organelle, an organ or an organism or a part thereof preferably to at least 5%, preferably to at least 20% or at to least 50%, especially preferably to at least 70%, 80%, 90% or more, very especially preferably are to at least 200%, most preferably are to at least 500% or more in comparison to the control, reference or wild type.

The specific activity of a polypeptide encoded by a nucleic acid molecule of the present invention or of the polypeptide of the present invention can be tested as described in the examples. In particular, the expression of a protein in question in a cell, e.g. a plant cell or a microorganism and the detection of an increase the fine chemical level in comparison to a control is an easy test and can be performed as described in the state of the art.

The term "increase" includes, that a compound or an activity is introduced into a cell de novo or that the compound or the activity has not been detectable before, in other words it is "generated".

Accordingly, in the following, the term "increasing" also comprises the term "generating" or "stimulating". The increased activity manifests itself in an increase of the fine chemical.

The transformed plant cells are compared to the corresponding non-transformed wild type of the same genus and species under otherwise identical conditions (such as, for example, culture conditions, age of the plants and the like). In this context, a change in metabolic activity of at least 10%, advantageously of at least 20%, preferably at least 30%, especially preferably of at least 40%, 50% or 60%, very especially preferably of at least 70%, 80%, 90%, 95% or even 100% or more, in comparison with the non-transformed organism is advantageous.

Preferably the change in metabolite concentration of the transformed plant cells is the changed compared to the corresponding non-transformed wild type. Preferably the change in metabolite concentration is measured by HPLC and calculated by dividing the peak height or peak area of each analyte (metabolite) through the peak area of the respective internal standards. Data is normalised using the individual sample fresh weight. The resulting values are divided by the mean values found for wild type plants grown under control conditions and analysed in the same sequence, resulting in the so-called ratios, which represent values independent of the analytical sequence. These ratios indicate the behavior of the metabolite concentration of the transformed plants in comparison to the concentration in the wild type control plants.

According to this method, the change in at least one metabolite concentration of the transformed plant cells compared to the corresponding non-transformed wild type is at least 10%, advantageously of at least 20%, preferably at least 40%, 60% or 80%, especially preferably of at least 90%, 100% or 200%, very, especially preferably of at least 700%, 800%, 900% 1000% or more.

Data significance can be determined by all statistical methods known by a person skilled in the art, preferably by a t-test, more preferably by the student t-test.

Altered metabolic activity also refers to metabolites that, compared to a corresponding non transformed wild type plant cell, are not produced after transformation or are only produced after transformation.

Preferred metabolites of the invention are 2,3-dimethyl-5-phytylquinol or 2-hydroxy-palmitic acid or 3,4-dihydroxyphenylalanine (=dopa) or 3-hydroxy-palmitic acid or 5-oxo-proline or alanine or alpha linolenic acid (c18:3 (c9, c12, c15)) or alpha-tocopherol or aminoadipic acid or anhydroglucose or arginine or aspartic acid or beta-apo-8' carotenal or beta-carotene or beta-sitosterol or beta-tocopherol or (delta-7-cis, 10-cis)-hexadecadienic acid or hexadecatrienic acid or margaric acid or delta-15-cis-tetracosenic acid or ferulic acid or campesterol or cerotic acid (c26:0) or citrulline or cryptoxanthine or eicosenoic acid (20:1) or fructose or fumarate or galactose or gamma-aminobutyric acid or gamma-tocopherol or gluconic acid or glucose or glutamic acid or glutamine or glycerate or glycerinaldehyd or glycerol or glycerol-3-phosphate or glycine or homoserine or inositol or iso-leucine or iso-maltose or isopentenyl pyrophosphate or leucine or lignoceric acid (c24:0) or linoleic acid (c18:2 (c9, c12)) or luteine or lycopene or malate or mannose or methionine or methylgalactofuranoside or methylgalactopyranoside or methylgalactopyranoside or palmitic acid (c16:0) or phenylalanine or phosphate or proline or putrescine or pyruvat or raffinose or ribonic acid or serine or shikimate or sinapine acid or stearic acid (c18:0) or succinate or sucrose or threonine or triacontanoic acid or tryptophane or tyrosine or ubichinone or udp-glucose or valine or zeaxanthine.

Metabolic activity may also be altered concerning one or more derivates to of one or more of the above metabolites.

Preferably metabolic activity is altered concerning one or more metabolites selected from the group consisting of all of the above metabolites.

Alternatively metabolic activity may be altered concerning one or more metabolites selected from the group consisting of mannose, inositol, phosphate, aspartic acid, isoleucine, leucine, gamma-aminobutyric acid, glycerinaldehyd, sucrose, campesterol, valine, beta-tocopherol, ubichinone, palmitic acid (c16:0), 2-hydroxy-palmitic acid, 2,3-dimethyl-5-phytylquinol, beta-carotene, alpha-linolenic acid (c18:3 (c9, c12, c15)), lycopene.

Alternatively metabolic activity may be altered concerning one or more metabolites selected from the group consisting of methylgalactofuranoside, beta-sitosterol, delta-15-cis-tetracosenic acid (c24:1 me), margaric acid (c17:0 me), stearic acid (c18:0), methylgalactopyranoside, gamma-tocopherol, linoleic acid (c18:2 (c9, c12)), hexadecatrienic acid (c16:3 me), shikimate, raffinose, glutamic acid, glutamine, udp-glucose, proline, threonine, isopentenyl pyrophosphate, 5-oxo-proline, ferulic acid, sinapine acid.

Alternatively metabolic activity may be altered concerning one or more metabolites selected from the group consisting of tryptophane, citrulline, serine, alanine, glycerate, arginine, 3-hydroxy-palmitic acid, putrescine, 3,4-dihydroxyphenylalanine (=dopa), alpha-tocopherol, aminoadipic acid, anhydroglucose, beta-apo-8' carotenal, delta-7-cis, 10-cis-hexadecadienic acid (c16:2 me), cerotic acid (c26:0), cryptoxanthine, eicosenoic acid (20:1), fructose, fumarate.

Alternatively metabolic activity may be altered concerning one or more metabolites selected from the group consisting of galactose, gluconic acid, glucose, glycerol, glycerol-3-phosphate, glycine, homoserine, iso-maltose, lignoceric acid (c24: 0), luteine, malate, triacontanoic acid, methionine, phenylalanine, pyruvate, ribonic acid, succinate, tyrosine, zeaxanthine.

The present invention provides a transgenic plant cell, wherein expression of said nucleic acid sequence in the plant cell results altered metabolic activity leading to increased tolerance and/or resistance to environmental stress as compared to a corresponding non-transformed wild type plant cell. One preferred wild type plant cell is a non-transformed *Arabidopsis* plant cell. An example here is the *Arabidopsis* wild type C24 (Nottingham *Arabidopsis* Stock Centre, UK; NASC Stock N906).

Other preferred wild type plant cells are a non-transformed from plants selected from the group consisting of maize, wheat, rye, oat, triticale, rice, barley, soybean, peanut, cotton, rapeseed, canola, manihot, pepper, sunflower, flax, borage, safflower, linseed, primrose, rapeseed, turnip rape, tagetes, solanaceous plants, potato, tobacco, eggplant, tomato, *Vicia* species, pea, alfalfa, coffee, cacao, tea, *Salix* species, oil palm, coconut, perennial grass and forage crops.

More preferred wild type plant cells are a non-transformed *Linum* plant cell, preferably *Linum usitatissimum*, more preferably the variety Brigitta, Golda, Gold Merchant, Helle, Juliel, Olpina, Livia, Marlin, Maedgold, Sporpion, Serenade, Linus, Taunus, Lifax or Liviola, a non-transformed Heliantus plant cell, preferably Heliantus annuus, more preferably the variety Aurasol, Capella, Flavia, Flores, Jazzy, Palulo, Pegasol, PIR64A54, Rigasol, Sariuca, Sideral, Sunny, Alenka, Candisol or Floyd, or a non-transformed *Brassica* plant cell, preferably *Brassica napus*, more preferably the variety Dorothy, Evita, Heros, Hyola, Kimbar, Lambada, Licolly, Liconira, Licosmos, Lisonne, Mistral, Passat, Serator, Siapula, Sponsor, Star, Caviar, Hybridol, Baical, Olga, Lara, Doublol, Karola, Falcon, Spirit, Olymp, Zeus, Libero, Kyola, Licord, Lion, Lirajet, Lisbeth, Magnum, Maja, Mendel, Mica, Mohican, Olpop, Ontarion, Panthar, Prinoe, Pronio, Susanna, Talani, Titan, Transfer, Wiking, Woltan, Zeniah, Artus, Contact or Smart.

The expression of said nucleic acid sequence in the plant cell may directly or indirectly influence the metabolic activity of the transformed plant cells. Preferably they influence the activity of the above metabolites.

Preferably metabolic activity may be altered by transformation with one or more Stress-Related Protein (SRP) coding nucleic acid selected from the group comprising the nucleic acid of FIG. 1a, 1b or 1c homologs of the afore mentioned sequences.

It is within the scope of the invention to identify the genes encoded by a nucleic acid sequence selected from the group consisting of the nucleic acid of FIG. 1a, 1b or 1c and/or homologs thereof in target plants, especially crop plants, and then express the corresponding gene to achieve the altered metabolic activity resulting in increased tolerance and/or resistance to environmental stress. Consequently the invention is not limited to a specific plant.

A protein having an activity conferring an altered metabolic activity preferably has the structure of the polypeptide described herein, in particular of the polypeptides comprising the consensus sequence shown in FIG. 2 or of the polypeptide as shown in FIG. 1a, 1b or 1c or the functional homologues thereof as described herein, or is encoded by the nucleic acid molecule characterized herein or the nucleic acid molecule according to the invention, for example by the nucleic acid molecule as shown in FIG. 1a, 1b or 1c or its herein described functional homologues and has the herein mentioned activity.

It is further possible to detect environmental stress in plant cells or plants by screening the plant cells for altered metabolic activity as compared to non-stress conditions. This allows for monitoring of stress levels in plants, even when no symptoms are visible. Therefore counter action can be taken ealier and e.g. crop losses minimized by timely watering.

It is also within the scope of the invention to screen plant cells or plants for increased tolerance and/or resistance to environmental stress by screening the plant cells under stress conditions for altered metabolic activity as compared to non-stress conditions. This allows selection of plants with increased tolerance and/or resistance to environmental stress without the identification of genes or visual symptoms.

With the invention it is further possible to breed plant cells or plants towards increased tolerance and/or resistance to environmental stress by screening the plant cells under stress conditions for altered metabolic activity as compared to non-stress conditions and selecting those with increased tolerance and/or resistance to environmental stress. The screening for metabolite activity is faster and easier than e.g. screening for genes.

Screening is well known to those skilled in the art and generally refers to the search for a particular attribute or trait. In the invention this trait in a plant or plant cell is preferably the concentration of a metabolite, especially preferred the concentration of the above metabolites. The methods and devices for screening are familiar to those skilled in the art and include GC (gas chromatography), LC (liquid chromatography), HPLC (high performance (pressure) liquid chromatography), MS (mass spectrometry), NMR (nuclear magnetic resonance) spectroscopy, IR (infra red) spectroscopy, photometric methods etc and combinations of these methods.

Breeding is also customary knowledge for those skilled in the art. It is understood as the directed and stable incorporation of a particular attribute or trait into a plant or plant cell.

The various breeding steps are characterized by well-defined human intervention such as selecting the lines to be crossed, directing pollination of the parental lines, or selecting appropriate progeny plants. Different breeding measures can be taken, depending on the desired properties. All the techniques are well known by a person skilled in the art and include for example, but are not limited to hybridization, inbreeding, backcross breeding, multiline breeding, variety blend, interspecific hybridization, aneuploid techniques, etc. Hybridization techniques also can include the sterilization of plants to yield male or female sterile plants by mechanical, chemical, or biochemical means. Cross pollination of a male sterile plant with pollen of a different line assures that the genome of the male sterile but female fertile plant will uniformly obtain properties of both of the parental lines. The transgenic seeds and plants according to the invention can therefor be used for the breeding of improved plant lines, which can increase the effectiveness of conventional methods such as herbicide or pesticide treatment or which allow one to dispense with said methods due to their modified genetic properties. Alternatively new crops with improved stress tolerance, preferably drought and temperature, can be obtained, which, due to their optimized genetic "equipment", yield harvested product of better quality than products that were not able to tolerate comparable adverse developmental conditions.

The invention provides that the environmental stress can be salinity, drought, temperature, metal, chemical, pathogenic and oxidative stresses, or combinations thereof, preferably drought and/or temperature.

The object of the invention is a transgenic plant cell, wherein the SRP (=stress related protein) is selected preferably from yeast, preferably *Saccharomyces cerevisiae*, or *E. coli* or a plant, preferably *Brassica napus, Glycine max*, or *Oryza saliva*.

Object of the invention is also a transgenic plant cell, wherein the SRP coding nucleic acid is at least about 50% homologous to one of the nucleic acid of FIG. 1*a*, 1*b* or 1*c*.

In the transgenic plant cell of the invention, the expression of said nucleic acid results in increased tolerance to an environmental stress, which is preferably achieved by altering metabolic activity, as compared to a corresponding non-transformed wild type plant cell. Herein, the environmental stress is selected from the group consisting of salinity, drought, temperature, metal, chemical, pathogenic and oxidative stresses, or combinations thereof, preferably drought and/or temperature.

The term "expression" refers to the transcription and/or translation of a codogenic gene segment or gene. As a rule, the resulting product is an mRNA or a protein. However, expression products can also include functional RNAs such as, for example, antisense, nucleic acids, tRNAs, snRNAs, rRNAs, RNAi, siRNA, ribozymes etc. Expression may be systemic, local or temporal, for example limited to certain cell types, tissue, sorgans or time periods.

Unless otherwise specified, the terms "polynucleotides", "nucleic acid" and "nucleic acid molecule" are interchangeably in the present context. Unless otherwise specified, the terms "peptide", "polypeptide" and "protein" are interchangeably in the present context. The term "sequence" may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, the terms "gene(s)", "polynucleotide", "nucleic acid sequence", "nucleotide sequence", or "nucleic acid molecule(s)" as used herein include double- and single-stranded DNA and RNA. They also include known types of modifications, for example, methylation, "caps", substitutions of one or more of the naturally occurring nucleotides with an analog. Preferably, the DNA or RNA sequence of the invention comprises a coding sequence encoding the herein defined polypeptide.

A "coding sequence" is a nucleotide sequence, which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to mRNA, cDNA, recombinant nucleotide sequences or genomic DNA, while introns may be present as well under certain circumstances.

For the purposes of the invention, as a rule the plural is intended to encompass the singular and vice versa.

Further, the transgenic plant cell is derived from a monocotyledonous plant. Alternative, the transgenic plant cell is derived from a dicotyledonous plant. Preferably, the transgenic plant cell is selected from the group consisting of maize, wheat, rye, oat, triticale, rice, barley, soybean, peanut, cotton, rapeseed; canola, manihot, pepper, sunflower, flax, borage, sufflower, linseed, primrose, rapeseed, turnip rape, tagetes, solanaceous plants, potato, tabacco, eggplant, tomato, *Vicia* species, pea, alfalfa, coffee, cacao, tea, *Salix* species, oil palm, coconut, perennial grass, forage crops and *Arabidopsis thaliana*. Moreover, the transgenic plant cell of the present invention can be derived from a gymnosperm plant. Preferably, the plant is selected from the group of spruce, pine and fir.

The invention further provides a seed produced by a transgenic plant transformed by a SRP coding nucleic acid, wherein the plant is true breeding for increased tolerance to environmental stress, which is preferably achieved by altering metabolic activity, as compared to a wild type plant cell. The transgenic plant might be a monocot, a dicot or a gymnosperm plant. The invention further provides a seed produced by a transgenic plant expressing an SRP wherein the plant is true breeding for increased tolerance to environmental stress, which is preferably achieved by altering metabolic activity, as compared to a wild type plant cell. The invention pertains to a seed produced by a transgenic plant, wherein the seed is genetically homozygous for a transgene conferring an increased tolerance to environmental stress, which is preferably achieved by altering metabolic activity, as compared to a wild type plant.

The invention further provides an agricultural product produced by any of the below-described transgenic plants, plant parts such as leafs, petal, anther, roots, tubers, stems, buds, flowers or seeds. The invention further provides a isolated recombinant expression vector comprising a SRP encoding nucleic acid.

The invention further provides a method of producing a transgenic plant with a SRP coding nucleic acid, wherein expression of the nucleic acid in the plant results in increased tolerance and/or resistance to an environmental stress, which is preferably achieved by altering metabolic activity, as compared to a corresponding non-transformed wild type plant cell, comprising a) transforming a plant cell with an expression vector including a SRP encoding nucleic acid selected from the group comprising the nucleic acid of FIG. 1a, 1b or 1c and/or homologs or parts thereof and b) generating from the plant cell a transgenic plant with an increased tolerance to environmental stress as compared to a corresponding non-transformed wild type plant.

With regard to invention described here, "transformed or transgene" means all those plants or parts thereof which have been brought about by genetic manipulation methods and in which either c) one or more genes, preferably encoded by one or more nucleic acid sequences as depicted in FIG. 1a, 1b or 1c and/or a homolog thereof, or d) a genetic regulatory element, for example a promoter, which is functionally linked e.g. to the nucleic acid sequence as depicted in FIG. 1a, 1b or 1c and/or a homolog thereof, or e) (a) and (b)

is/are not present in its/their natural genetic environment or has/have been modified by means of genetic manipulation methods, it being possible for the modification to be, by way of example, a substitution, addition, deletion, inversion or insertion of one or more nucleotide radicals.

"Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp.

In said method for producing a transgenic plant comprising an SRP, the SRP coding nucleic acid is selected from the group comprising the nucleic acid of FIG. 1a, 1b or 1c and/or homologs of the afore mentioned sequences. Further, the SRP coding nucleic acid used in the said method is at least about 50% homologous to one of the nucleic acid of FIG. 1a, 1b or 1c.

A plant or plant cell is considered "true breeding" for a particular trait if it is genetically homozygous for that trait to the extent that, when the true-breeding plant is self-pollinated, a significant amount of independent segregation of the trait among the progeny is not observed. In the present invention, the trait arises from the transgenic expression of one or more DNA sequences introduced into a plant cell or plant.

The present invention also provides methods of modifying stress tolerance of a plant comprising, modifying the level of expression of a SRP nucleic acid in the plant. The invention provides one method of producing a transgenic plant with a synthetic, novel or modified transcription factor that acts by increasing the transcription of a SRP gene. Theoretically it is also possible to obtain a decrease in expression of the gene.

A method of detecting environmental stress in plant cells or plants comprising screening the plant cells for altered metabolic activity as compared to non-stress conditions is also in the scope of the invention.

Further a method of screening plant cells or plants for increased tolerance and/or resistance to environmental stress comprising screening the plant cells under stress conditions for altered metabolic activity as compared to non-stress conditions is encompassed in the invention.

The present invention also encloses a method of breeding plant cells or plants towards increased tolerance and/or resistance to environmental stress comprising screening the plant cells under stress conditions for altered metabolic activity as compared to non-stress conditions and selecting those with increased tolerance and/or resistance to environmental stress.

In these methods metabolite activity is preferably altered concerning the above metabolites and groups of metabolites.

The present invention also encompasses the use of altered metabolic activity and/or a SRP encoding nucleic acid selected from the group comprising the nucleic acid of FIG. 1a, 1b or 1c and/or homologs of the afore mentioned sequences or parts thereof as markers for selection of plants or plant cells with increased tolerance to environmental stress.

The present invention further encompasses the use of altered metabolic activity and/or a SRP encoding nucleic acid selected from the group comprising the nucleic acid of FIG. 1a, 1b or 1c and/or homologs of the afore mentioned sequences or parts thereof as markers for detection of stress in plants or plant cells.

The present invention also provides methods of modifying stress tolerance of a crop plant comprising utilizing a SRP coding nucleic acid sequence to identify individual plants in populations segregating for either increased or decreased environmental stress tolerance (DNA marker).

In the said method of modifying stress tolerance of a plant the SRP encoding nucleic acid may be selected from the group comprising the nucleic acid of FIG. 1a, 1b or 1c and/or homologs of the afore mentioned sequences. Further the SRP coding nucleic acid used therein may at least about 50% homologous to one of the nucleic acid of FIG. 1a, 1b or 1c. Also an expression vector as described in the present invention might be used in the said method.

In a variant method of said method of modifying stress tolerance, the plant is transformed with an inducible promoter that directs expression of the SRP. For example, the promoter is tissue specific. In a variant method, the used promoter is developmentally regulated.

In a further embodiment, the method of modifying stress tolerance comprises one or more of the following steps:
a) stabilizing a protein conferring the increased expression of a protein encoded by the nucleic acid molecule of the invention or of the polypeptid of the invention having the herein-mentioned activity of altering the metabolic activity;
b) stabilizing a mRNA conferring the increased expression of a protein encoded by the nucleic acid molecule of the invention or its homologs or of a mRNA encoding the polypeptide of the present invention having the herein-mentioned activity of altering the metabolic activity;
c) increasing the specific activity of a protein conferring the increased expression of a protein encoded by the nucleic acid molecule of the invention or of the polypeptide of the present invention or decreasing the inhibitory regulation of the polypeptide of the invention;
d) generating or increasing the expression of an endogenous or artificial transcription factor mediating the expression of a protein conferring the increased expression of a protein encoded by the nucleic acid molecule of the invention or of the polypeptide of the invention having the herein-mentioned activity of altering the metabolic activity;
e) stimulating activity of a protein conferring the increased expression of a protein encoded by the nucleic acid molecule of the present invention or a polypeptide of the present invention having the herein-mentioned activity of altering the metabolic activity by adding one or more exogenous inducing factors to the organismus or parts thereof;
f) expressing a transgenic gene encoding a protein conferring the increased expression of a polypeptide encoded by the nucleic acid molecule of the present invention or a polypeptide of the present invention, having the herein-mentioned activity of altering the metabolic activity; and/or
g) increasing the copy number of a gene conferring the increased expression of a nucleic acid molecule encoding a polypeptide encoded by the nucleic acid molecule of the invention or the polypeptide of the invention having the herein-mentioned activity of altering the metabolic activity;
h) increasing the expression of the endogenous gene encoding the polypeptide of the invention or its homologs by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements-positive elements can be randomly introduced in plants by T-DNA or transposon mutagenesis and lines can be identified in which the positive elements have be integrated near to a gene of the invention, the expression of which is thereby enhanced; and/or
i) modulating growth conditions of the plant in such a manner, that the expression or activity of the gene encoding the protein of the invention or the protein itself is enhanced;
j) selecting of organisms with especially high activity of the proteins of the invention from natural or from mutagenized resources and breeding them into the target organisms, eg the elite crops.

Preferably, said mRNA is the nucleic acid molecule of the present invention and/or the protein conferring the increased expression of a protein encoded by the nucleic acid molecule of the present invention or the polypeptide having the herein mentioned activity is the polypeptide of the present invention, e.g. conferring increased tolerance to environmental stress by altering the metabolic activity.

In general, the amount of mRNA, polynucleotide or nucleic acid molecule in a cell or a compartment of an organism correlates with the amount of encoded protein and thus with the overall activity of the encoded protein in said volume. Said correlation is not always linear, the activity in the volume is dependent on the stability of the molecules, the degradation of the molecules or the presence of activating or inhibiting co-factors. Further, product and educt inhibitions of enzymes are well known, e.g. Zinser et al. "Enzyminhibitoren/Enzyme inhibitors".

The activity of the abovementioned proteins and/or poylpeptide encoded by the nucleic acid molecule of the present invention can be increased in various ways. For example, the activity in an organism or in a part thereof, like a cell, is increased via increasing the gene product number, e.g. by increasing the expression rate, like introducing a stronger promoter, or by increasing the stability of the mRNA expressed, thus increasing the translation rate, and/or increasing the stability of the gene product, thus reducing the proteins decayed. Further, the activity or turnover of enzymes can be influenced in such a way that a reduction or increase of the reaction rate or a modification (reduction or increase) of the affinity to the substrate results, is reached. A mutation in the catalytic centre of an polypeptide of the invention, e.g. as enzyme, can modulate the turn over rate of the enzyme, e.g. a knock out of an essential amino acid can lead to a reduced or completely knock out activity of the enzyme, or the deletion or mutation of regulator binding sites can reduce a negative regulation like a feedback inhibition (or a substrate inhibition, if the substrate level is also increased). The specific activity of an enzyme of the present invention can be increased such that the turn over rate is increased or the binding of a co-factor is improved. Improving the stability of the encoding mRNA or the protein can also increase the activity of a gene product. The stimulation of the activity is also under the scope of the term "increased activity".

Moreover, the regulation of the abovementioned nucleic acid sequences may be modified so that gene expression is increased. This can be achieved advantageously by means of heterologous regulatory sequences or by modifying, for example mutating, the natural regulatory sequences which are present. The advantageous methods may also be combined with each other.

In general, an activity of a gene product in an organism or part thereof, in particular in a plant cell, a plant, or a plant tissue or a part thereof or in a microorganism can be increased by increasing the amount of the specific encoding mRNA or the corresponding protein in said organism or part thereof. "Amount of protein or mRNA" is understood as meaning the molecule number of polypeptides or mRNA molecules in an organism, a tissue, a cell or a cell compartment. "Increase" in the amount of a protein means the quantitative increase of the molecule number of said protein in an organism, a tissue, a cell or a cell compartment or part thereof—for example by one of the methods described herein below—in comparison to a wild type, control or reference.

The increase in molecule number amounts preferably to at least 1%, preferably to more than 10%, more preferably to 30% or more, especially preferably to 50%, 70% or more, very especially preferably to 100%, most preferably to 500% or more. However, a de novo expression is also regarded as subject of the present invention.

A modification, i.e. an increase or decrease, can be caused by endogenous or exogenous factors. For example, an increase in activity in an organism or a part thereof can be caused by adding a gene product or a precursor or an activator or an agonist to the media or nutrition or can be caused by introducing said subjects into a organism, transient or stable.

In one embodiment the increase or decrease in metabolic activity in the plant or a part thereof, e.g. in a cell, a tissue, a organ, an organelle etc., is achieved by increasing the endogenous level of the polypeptide of the invention. Accordingly, in an embodiment of the present invention, the present invention relates to a process wherein the gene copy number of a gene encoding the polynucleotide or nucleic acid molecule of the invention is increased. Further, the endogenous level of the polypeptide of the invention can for example be increased by modifying the transcriptional or translational regulation of the polypeptide.

In one embodiment the metabolic activity in the plant or part thereof can be altered by targeted or random mutagenesis of the endogenous genes of the invention. For example homologous recombination can be used to either introduce positive regulatory elements like for plants the 35S enhancer into the promoter or to remove repressor elements form regulatory regions. In addition gene conversion like methods described by Kochevenko and Willmitzer (Plant Physiol. 2003 May; 132(1):174-84) and citations therein can be used to disrupt repressor elements or to enhance to activity of positive regulatory elements. Furthermore positive elements can be randomly introduced in (plant) genomes by T-DNA or transposon mutagenesis and lines can be screened for, in which the positive elements has be integrated hear to a gene of the invention, the expression of which is thereby enhanced. The activation of plant genes by random integrations of enhancer elements has been described by Hayashi et al., 1992 (Science 258:1350-1353) or Weigel et al., 2000 (Plant Physiol. 122, 1003-1013) and others cited therein.

Reverse genetic strategies to identify insertions (which eventually carrying the activation elements) near in genes of interest have been described for various cases eg. Krysan et al., 1999 (Plant Cell 1999, 11, 2283-2290); Sessions et al., 2002 (Plant Cell 2002, 14, 2985-2994); Young et al., 2001, (Plant Physiol. 2001, 125, 513-518); Koprek et al., 2000 (Plant J. 2000, 24, 253-263); Jeon et al., 2000 (Plant J. 2000, 22, 561-570); Tissier et al., 1999 (Plant Cell 1999, 11, 1841-1852); Speulmann et al., 1999 (Plant Cell 1999, 11, 1853-1866). Briefly material from all plants of a large T-DNA or transposon mutagenized plant population is harvested and genomic DNA prepared. Then the genomic DNA is pooled following specific architectures as described for example in Krysan et al., 1999 (Plant Cell 1999, 11, 2283-2290). Pools of genomics DNAs are then screened by specific multiplex PCR reactions detecting the combination of the insertional mutagen (eg T-DNA or Transposon) and the gene of interest. Therefore PCR reactions are run on the DNA pools with specific combinations of T-DNA or transposon border primers and gene specific primers. General rules for primer design can again be taken from Krysan et al., 1999 (Plant Cell 1999, 11, 2283-2290) Rescreening of lower levels DNA pools lead to the identification of individual plants in which the gene of interest is activated by the insertional mutagen.

The enhancement of positive regulatory elements or the disruption or weaking of negative regulatory elements can also be achieved through common mutagenesis techniques: The production of chemically or radiation mutated populations is a common technique and known to the skilled worker. Methods for plants are described by Koorneef et al. 1982 and the citations therein and by Lightner and Caspar in "Methods in Molecular Biology" Vol 82. These techniques usually induce pointmutations that can be identified in any known gene using methods such as TILLING (Colbert et al. 2001).

Accordingly, the expression level can be increased if the endogenous genes encoding a polypeptide conferring an increased expression of the polypeptide of the present invention, in particular genes comprising the nucleic acid molecule of the present invention, are modified via homologous recombination, Tilling approaches or gene conversion Regulatory sequences can be operatively linked to the coding region of an endogenous protein and control its transcription and translation or the stability or decay of the encoding mRNA or the expressed protein. In order to modify and control the expression, promoter, UTRs, splicing sites, processing signals, polyadenylation sites, terminators, enhancers, repressors, post transcriptional or posttranslational modification sites can be changed, added or amended For example, the activation of plant genes by random integrations of enhancer elements has been described by Hayashi et al., 1992 (Science 258:1350-1353) or Weigel et al., 2000 (Plant Physiol. 122, 1003-1013) and others cited therein. For example, the expression level of the endogenous protein can be modulated by replacing the endogenous promoter with a stronger transgenic promoter or by replacing the endogenous 3'UTR with a 3'UTR, which provides more stability without amending the coding region. Further, the transcriptional regulation can be modulated by introduction of a artificial transcription factor as described in the examples. Alternative promoters, terminators and UTRs are described below.

The activation of an endogenous polypeptide having above-mentioned activity, e.g. conferring an increased tolerance to environmental stress after altering the metabolic activity can also be increased by introducing a synthetic transcription factor, which binds close to the coding region of the protein of the invention encoding gene and activates its transcription. A chimeric zinc finger protein can be construed, which comprises a specific DNA-binding domain and an activation domain as e.g. the VP16 domain of Herpes Simplex virus. The specific binding domain can bind to the regulatory region of the protein coding region. The expression of the chimeric transcription factor in a plant leads to a specific expression of the protein of the invention, see e.g. in WO01/52620, Oriz, Proc. Natl. Acad. Sci. USA, 2002, Vol. 99, 13290 or Guan, Proc. Natl. Acad. Sci. USA, 2002, Vol. 99, 13296.

In one further embodiment of the method according to the invention, plants are used in which one of the abovementioned genes, or one of the abovementioned nucleic acids, is mutated in a way that the activity of the encoded gene products is less influenced by cellular factors, or not at all, in comparison with the unmutated proteins. For example, well known regulation mechanism of enzymic activity are substrate inhibition or feed back regulation mechanisms. Ways and techniques for the introduction of substitutions, deletions and additions of one or more bases, nucleotides or amino acids of a corresponding sequence are described herein below in the corresponding paragraphs and the references listed there, e.g. in Sambrook et al., Molecular Cloning, Cold Spring Habour, N.Y., 1989. The person skilled in the art will be able to identify regulation domains and binding sites of regulators by comparing the sequence of the nucleic acid molecule of the present invention or the expression product thereof with the state of the art by computer software means which comprise algorithms for the identifying of binding sites and regulation domains or by introducing into a nucleic acid molecule or in a protein systematically mutations and assaying for those mutations which will lead to an increased specify activity or an increased activity per volume, in particular per cell.

It is therefore advantageously to express in a plant a nucleic acid molecule of the invention or a polypeptide of the invention derived from a evolutionary distantly related organism, as e.g. using a prokaryotic gene in a eukaryotic host, as in these cases the regulation mechanism of the host cell may not weaken the activity (cellular or specific) of the gene or its expression product The mutation is introduced in such a way that the production of the amino acids is not adversely affected.

Less influence on the regulation of a gene or its gene product is understood as meaning a reduced regulation of the enzymatic activity leading to an increased specific or cellular activity of the gene or its product. An increase of the enzymatic activity is understood as meaning an enzymatic activity, which is increased by at least 10%, advantageously at least 20, 30 or 40%, especially advantageously by at least 50, 60 or 70% in comparison with the starting organism.

The invention provides that the above methods can be performed such that the stress tolerance is increased. It is also possible to obtain a decrease in stress tolerance.

The invention is not limited to specific nucleic acids, specific polypeptides, specific cell types, specific host cells, specific conditions or specific methods etc. as such, but may vary and numerous modifications and variations therein will be apparent to those skilled in the art. It is also to be understood that the terminology used herein is for the purpose of describing specific embodiments only and is not intended to be limiting.

The present invention also relates to isolated Stress Related Proteins (SRP) which are selected from the group comprising the proteins of FIG. 1a, 1b or 1c and/or homologs thereof. Preferably, the isolated Stress Related Proteins (SRP) of the present invention are selected from yeast or *E. coli*. Further, the present invention is related to isolated Stress Related Protein (SRP) encoding nucleic acids selected from the group comprising the nucleic acid of FIG. 1a, 1b or 1c and/or homologs thereof. Here, preferably, an isolated Stress Related Protein (SRP) encoding nucleic acid encodes an SRP which is selected from yeast or *E. coli*.

The present invention provides stress related gene sequences selected from the group consisting of the the nucleic acid of FIG. 1a, 1b or 1c of yeast, preferably from *Saccharomyces cerevisiae* or *E. coli*.

Homologs of the aforementioned sequences can be isolated advantageously from yeast, fungi, viruses, algae, bacteria, such as *Acetobacter* (subgen. *Acetobacter*) *aceti*; *Acidithiobacillus ferrooxidans*; *Acinetobacter* sp.; *Actinobacillus* sp; *Aeromonas salmonicida*; *Agrobacterium tumefaciens*; *Aquifex aeolicus*; *Arcanobacterium pyogenes*; Aster yellows phytoplasma; *Bacillus* sp.; *Bifidobacterium* sp.; *Borrelia burgdorferi*; *Brevibacterium linens*; *Brucella melitensis*; *Buchnera* sp.; *Butyrivibrio fibrisolvens*; *Campylobacter jejuni*; *Caulobacter crescentus*; *Chlamydia* sp.; *Chlamydophila* sp.; *Chlorobium limicola*; *Citrobacter rodentium*; *Clostridium* sp.; *Comamonas testosteroni*; *Corynebacterium* sp.; *Coxiella burnetii*; *Deinococcus radiodurans*; *Dichelobacter nodosus*; *Edwardsiella ictaluri*; *Enterobacter* sp.; *Erysipelothrix rhusiopathiae*; *Escherichia coli*; *Flavobacterium* sp.; *Francisella tularensis*; *Frankia* sp. Cpl1; *Fusobacterium nucleatum*; *Geobacillus stearothermophilus*; *Gluconobacter oxydans*; *Haemophilus* sp.; *Helicobacter pylori*; *Klebsiella pneumoniae*; *Lactobacillus* sp.; *Lactococcus lactis*; *Listeria* sp.; *Mannheimia haemolytica*; *Mesorhizobium loti*; *Methylophaga thalassica*; *Microcystis aeruginosa*; *Microscilla* sp. PREL; *Moraxella* sp. TA144; *Mycobacterium* sp.; *Mycoplasma* sp.; *Neisseria* sp.; *Nitrosomonas* sp.; *Nostoc* sp. PCC 7120; *Novosphingobium aromaticivorans*; *Oenococcus oeni*; *Pantoea citrea*; *Pasteurella multocida*; *Pediococcus pentosaceus*; *Phormidium foveolarum*; *Phytoplasma* sp.; *Plectonema boryanum*; *Prevotella ruminicola*; *Propionibacterium* sp.; *Proteus vulgaris*; *Pseudomonas* sp.; *Raistonia* sp.; *Rhizobium* sp.; *Rhodococcus equi*; *Rhodothermus marinus*; *Rickettsia* sp.; *Riemerella anatipestifer*; *Ruminococcus flavefaciens*; *Salmonella* sp.; *Selenomonas ruminantium*; *Serratia entomophila*; *Shigella* sp.; *Sinorhizobium meliloti*; *Staphylococcus* sp.; *Streptococcus* sp.; *Streptomyces* sp.; *Synechococcus* sp.; *Synechocystis* sp. PCC 6803; *Thermotoga maritima*; *Treponema* sp.; *Ureaplasma urealyticum*; *Vibrio cholerae*; *Vibrio parahaemolyticus*; *Xylella fastidiosa*; *Yersinia* sp.; *Zymomonas mobilis*, preferably *Salmonella* sp. or *Escherichia coli* or plants, preferably from yeasts such as from the genera *Saccharomyces, Pichia, Candida, Hansenula, Torulopsis* or *Schizosaccharomyces* or plants such as *Arabidopsis thaliana*, maize, wheat, rye, oat, triticale, rice, barley, soybean, peanut, cotton, borage, sufflower, linseed, primrose, rapeseed, canola and turnip rape, manihot, pepper, sunflower, tagetes, solanaceous plant such as potato, tobacco, eggplant and tomato, *Vicia* species, pea, alfalfa, bushy plants such as coffee, cacao, tea, *Salix* species, trees such as oil palm, coconut, perennial grass, such as ryegrass and fescue, and forage crops, such as alfalfa and clover and from spruce, pine or fir for example. More preferably homologs of aforementioned sequences can be isolated from *Saccharomyces cerevisiae, E. coli* or plants, preferably *Brassica napus, Glycine max*, or *Oryza sativa*.

The stress related proteins of the present invention are preferably produced by recombinant DNA techniques. For example, a nucleic acid molecule encoding the protein is cloned into an expression vector, for example in to a binary vector, the expression vector is introduced into a host cell, for example the *Arabidopsis thaliana* wild type NASC N906 or any other plant cell as described in the examples see below, and the stress related protein is expressed in said host cell. Examples for binary vectors are pBIN19, pBl101, pBinAR, pGPTV, pCAMBIA, pBIB-HYG, pBecks, pGreen or pPZP (Hajukiewicz, P. et al., 1994, Plant Mol. Biol., 25: 989-994 and Hellens et al, Trends in Plant Science (2000) 5, 446-451.).

Advantageously, the nucleic acid sequences according to the invention or the gene construct together with at least one reporter gene are cloned into an expression cassette, which is introduced into the organism via a vector or directly into the genome. This reporter gene should allow easy detection via a growth, fluorescence, chemical, bioluminescence or resistance assay or via a photometric measurement. Examples of reporter genes which may be mentioned are antibiotic- or herbicide-resistance genes, hydrolase genes, fluorescence protein genes, bioluminescence genes, sugar or nucleotide metabolic genes or biosynthesis genes such as the Ura3 gene, the Ilv2 gene, the luciferase gene, the β-galactosidase gene, the gfp gene, the 2-desoxyglucose-6-phosphate phosphatase gene, the β-glucuronidase gene, β-lactamase gene, the neomycin phosphotransferase gene, the hygromycin phosphotransferase gene or the BASTA (=gluphosinate-resistance) gene. These genes permit easy measurement and quantification of the transcription activity and hence of the expression of the genes. In this way genome positions may be identified which exhibit differing productivity.

In a preferred embodiment a nucleic acid construct, for example an expression cassette, comprises upstream, i.e. at the 5' end of the encoding sequence, a promoter and downstream, i.e. at the 3' end, a polyadenylation signal and optionally other regulatory elements which are operably linked to the intervening encoding sequence with the nucleic acid of FIG. 1a, 1b or 1c. By an operable linkage is meant the sequential arrangement of promoter, encoding sequence, terminator and optionally other regulatory elements in such a way that each of the regulatory elements can fulfill its function in the expression of the encoding sequence in due manner. The sequences preferred for operable linkage are targeting sequences for ensuring subcellular localization in plastids. However, targeting sequences for ensuring subcellular localization in the mitochondrium, in the endoplasmic reticulum (=ER), in the nucleus, in oil corpuscles or other compartments may also be employed as well as translation promoters such as the 5' lead sequence in tobacco mosaic virus (Gallie et al., Nucl. Acids Res. 15 (1987), 8693-8711).

A nucleic acid construct, for example an expression cassette may, for example, contain a constitutive promoter or a tissue-specific promoter (preferably the USP or napin promoter) the gene to be expressed and the ER retention signal. For the ER retention signal the KDEL amino acid sequence (lysine, aspartic acid, glutamic acid, leucine) or the KKX amino acid sequence (lysine-lysine-X-stop, wherein X means every other known amino acidy is preferably employed.

For expression in a prokaryotic or eukaryotic host organism, for example a microorganism such as a fungus or a plant the expression cassette is advantageously inserted into a vector such as by way of example a plasmid, a phage or other DNA which allows optimum expression of the genes in the host organism. Examples of suitable plasmids are: in *E. coli* pLG338, pACYC184, pBR series such as e.g. pBR322, pUC series such as pUC18 or pUC19, M113 mp series, pKC30, pRep4, pHS1, pHS2, pPLc236, pMBL24, pLG200, pUR290, pIN-III$^{113}$-B1, λgt11 or pBdCl; in *Streptomyces* pIJ101, pIJ364, pIJ702 or pIJ361; in *Bacillus* pUB110, pC194 or pBD214; in *Corynebacterium* pSA77 or pAJ667; in fungi pALS1, pIL2 or pBB116; other advantageous fungal vectors are described by Romanos, M. A. et al., [(1992) "Foreign gene expression in yeast: a review", *Yeast* 8: 423-488] and by van den Hondel, C. A. M. J. J. et al. [(1991) "Heterologous gene expression in filamentous fungi" as well as in More Gene Manipulations in Fungi [J. W. Bennet & L. L. Lasure, eds., pp. 396-428: Academic Press: San Diego] and in "Gene transfer systems and vector development for filamentous fungi" [van den Hondel, C. A. M. J. J. & Punt, P. J. (1991) in: Applied Molecular Genetics of Fungi, Peberdy, J. F. et al., eds., pp. 1-28, Cambridge University Press: Cambridge]. Examples of advantageous yeast promoters are 2 μM, pAG-1, YEp6, YEp13 or pEMBLYe23. Examples of algal or plant promoters are pLGV23, pGHlac$^+$, pBIN19, pAK2004, pVKH or pDH51 (see Schmidt, R. and Willmitzer, L., 1988). The vectors identified above or derivatives of the vectors identified above are a small selection of the possible plasmids. Further plasmids are well known to those skilled in the art and may be found, for example, in the book Cloning Vectors (Eds. Pouwels P. H. et al. Elsevier, Amsterdam-New York-Oxford, 1985, ISBN0 444 904018). Suitable plant vectors are described inter alia in "Methods in Plant Molecular Biology and Biotechnology" (CRC Press), Ch. 6/7, pp. 71-119. Advantageous vectors are known as shuttle vectors or binary vectors which replicate in *E. coli* and *Agrobacterium.*

By vectors is meant with the exception of plasmids all other vectors known to those skilled in the art such as by way of example phages, viruses such as SV40, CMV, baculovirus, adenovirus, transposons, IS elements, phasmids, phagemids, cosmids, linear or circular DNA. These vectors can be replicated autonomously in the host organism or be chromosomally replicated, chromosomal replication being preferred.

In a further embodiment of the vector the expression cassette according to the invention may also advantageously be introduced into the organisms in the form of a linear DNA and be integrated into the genome of the host organism by way of heterologous or homologous recombination. This linear DNA may be composed of a linearized plasmid or only of the expression cassette as vector or the nucleic acid sequences according to the invention.

In a further advantageous embodiment the nucleic acid sequence according to the invention can also be introduced into an organism on its own.

If in addition to the nucleic acid sequence according to the invention further genes are to be introduced into the organism, all together with a reporter gene in a single vector or each single gene with a reporter gene in a vector in each case can be introduced into the organism, whereby the different vectors can be introduced simultaneously or successively.

The vector advantageously contains at least one copy of the nucleic acid sequences according to the invention and/or the expression cassette (=gene construct) according to the invention.

The invention further provides an isolated recombinant expression vector comprising a SRP nucleic acid as described above, wherein expression of the vector in a host cell results in increased tolerance to environmental stress as compared to a wild type variety of the host cell. As used herein, the term "vector" refers to a nucleic acid molecule capable of transporting another nucleic acid to which it has been linked. One type of vector is a "plasmid," which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors." In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses, and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. As used herein with respect to a recombinant expression vector, "operatively linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers, and other expression control elements (e.g., polyadenylation signals). Such regulatory sequences are described, for example, in Goeddel, Gene Expression Technology: Methods in Enzymology 185, Academic Press, San Diego, Calif. (1990) and Gruber and Crosby, in: Methods in Plant Molecular Biology and Biotechnology, eds. Glick and Thompson, Chapter 7, 89-108, CRC Press: Boca Raton, Fla., including the references therein. Regulatory sequences include those that direct constitutive expression of a nucleotide sequence in many types of host cells and those that direct expression of the nucleotide sequence only in certain host cells or under certain conditions. It will be appreciated by those skilled in the art that the design of the expression vector can depend on such factors as the choice of the host cell to be transformed, the level of expression of polypeptide desired, etc. The expression vectors of the invention can be introduced into host cells to thereby produce polypeptides or peptides, including fusion polypeptides or peptides, encoded by nucleic acids as described herein (e.g., SRPs, mutant forms of SRPs, fusion polypeptides, etc.).

The recombinant expression vectors of the invention can be designed for expression of SRPs in prokaryotic or eukaryotic cells. For example, SRP genes can be expressed in bacterial cells such as *C. glutamicum*, insect cells (using baculovirus expression vectors), yeast and other fungal cells (See Romanos, M. A. et al., 1992, Foreign gene expression in yeast: a review, Yeast 8:423-488; van den Hondel, C. A. M. J. J. et al., 1991, Heterologous gene expression in filamentous fungi, in: More Gene Manipulations in Fungi, J. W. Bennet & L. L. Lasure, eds., p. 396-428: Academic Press: San Diego; and van den Hondel, C. A. M. J. J. & Punt, P. J., 1991, Gene transfer systems and vector development for filamentous fungi, in: Applied Molecular Genetics of Fungi, Peberdy, J. F. et al., eds., p. 1-28, Cambridge University Press: Cambridge), algae (Falciatore et al., 1999, Marine Biotechnology 1(3): 239-251), ciliates of the types: *Holotrichia, Peritrichia, Spirotrichia, Suctoria, Tetrahymena, Paramecium, Colpidium, Glaucoma, Platyophrya, Potomacus, Pseudocohnilembus, Euplotes, Engelmaniella*, and *Stylonychia*, especially of the genus *Stylonychia lemnae* with vectors following a transformation method as described in PCT Application No. WO 98/01572, and multicellular plant cells (See Schmidt, R. and Willmitzer, L., 1988, High efficiency *Agrobacterium tumefaciens*-mediated transformation of *Arabidopsis thaliana* leaf and cotyledon explants, Plant, Cell Rep. 583-586; Plant Molecular Biology and Biotechnology, C Press, Boca Raton, Fla., chapter 6/7, S.71-119 (1993); F. F. White, B. Jenes et al., Techniques for Gene Transfer, in: Transgenic Plants, Vol. 1, Engineering and Utilization, eds. Kung und R. Wu, 128-43, Academic Press: 1993; Potrykus, 1991, Annu. Rev. Plant Physiol. Plant Molec. Biol. 42:205-225 and references cited therein) or mammalian cells. Suitable host cells are discussed further in Goeddel, Gene Expression Technology: Methods in Enzymology 185, Academic Press: San Diego, Calif. (1990). Alternatively, the recombinant expression vector can be transcribed and translated in vitro, for example using T7 promoter regulatory sequences and T7 polymerase.

Expression of polypeptides in prokaryotes is most often carried out with vectors containing constitutive or inducible promoters directing the expression of either fusion or non-fusion polypeptides. Fusion vectors add a number of amino acids to a polypeptide encoded therein, usually to the amino terminus of the recombinant polypeptide but also to the C-terminus or fused within suitable regions in the polypeptides. Such fusion vectors typically serve three purposes: 1) to increase expression of a recombinant polypeptide; 2) to increase the solubility of a recombinant polypeptide; and 3) to aid in the purification of a recombinant polypeptide by acting as a ligand in affinity purification. Often, in fusion expression vectors, a proteolytic cleavage site is introduced at the junction of the fusion moiety and the recombinant polypeptide to enable separation of the recombinant polypeptide from the fusion moiety subsequent to purification of the fusion polypeptide. Such enzymes, and their cognate recognition sequences, include Factor Xa, thrombin, and enterokinase.

By way of example the plant expression cassette can be installed in the pRT transformation vector ((a) Toepfer et al., 1993, Methods Enzymol., 217: 66-78; (b) Toepfer et al. 1987, Nucl. Acids. Res. 15: 5890 ff.).

Alternatively, a recombinant vector (=expression vector) can also be transcribed and translated in vitro, e.g. by using the T7 promoter and the T7 RNA polymerase.

Expression vectors employed in prokaryotes frequently make use of inducible systems with and without fusion proteins or fusion oligopeptides, wherein these fusions can ensue in both N-terminal and C-terminal manner or in other useful domains of a protein. Such fusion vectors usually have the following purposes: i.) to increase the RNA expression rate; ii.) to increase the achievable protein synthesis rate; iii.) to increase the solubility of the protein; iv.) or to simplify purification by means of a binding sequence usable for affinity chromatography. Proteolytic cleavage points are also frequently introduced via fusion proteins, which allow cleavage of a portion of the fusion protein and purification. Such recognition sequences for proteases are recognized, e.g. factor Xa, thrombin and enterokinase.

Typical advantageous fusion and expression vectors are pGEX [Pharmacia Biotech Inc; Smith, D. B. and Johnson, K. S. (1988) Gene 67: 31-40], pMAL (New England Biolabs, Beverly, Mass.) and pRIT5 (Pharmacia, Piscataway, N.J.) which contains glutathione S-transferase (GST), maltose binding protein or protein A.

In one embodiment, the coding sequence of the SRP is cloned into a pGEX expression vector to create a vector encoding a fusion polypeptide comprising, from the N-terminus to the C-terminus, GST-thrombin cleavage site-X polypeptide. The fusion polypeptide can be purified by affinity chromatography using glutathione-agarose resin. Recombinant PKSRP unfused to GST can be recovered by cleavage of the fusion polypeptide with thrombin.

Other examples of *E. coli* expression vectors are pTrc [Amann et al., (1988) *Gene* 69:301-315] and pET vectors [Studier et al., Gene Expression Technology: Methods in Enzymology 185, Academic Press, San Diego, Calif. (1990) 60-89; Stratagene, Amsterdam, The Netherlands].

Target gene expression from the pTrc vector relies on host RNA polymerase transcription from a hybrid trp-lac fusion promoter. Target gene expression from the pET 11d vector relies on transcription from a T7 gn10-lac fusion promoter mediated by a co-expressed viral RNA polymerase (T7 gn1). This viral polymerase is supplied by host strains BL21(DE3) or HMS174(DE3) from a resident λ prophage harboring a T7 gn1 gene under the transcriptional control of the lacUV 5 promoter.

One strategy to maximize recombinant polypeptide expression is to express the polypeptide in a host bacteria with an impaired capacity to proteolytically cleave the recombinant polypeptide (Gottesman, S., Gene Expression Technology: Methods in Enzymology 185, Academic Press, San Diego, Calif. (1990) 119-128). Another strategy is to alter the sequence of the nucleic acid to be inserted into an expression vector so that the individual codons for each amino acid are those preferentially utilized in the bacterium chosen for expression, such as *C. glutamicum* (Wada et al., 1992, Nucleic Acids Res. 20:2111-2118). Such alteration of nucleic acid sequences of the invention can be carried out by standard DNA synthesis techniques.

Other advantageous vectors for use in yeast are pYepSec1 (Baldari, et al., (1987) Embo J. 6:229-234), pMFa (Kurjan and Herskowitz, (1982). Cell 30:933-943), pJRY88 (Schultz et al., (1987) Gene 54:113-123), and pYES derivatives (Invitrogen Corporation, San Diego, Calif.). Vectors for use in filamentous fungi are described in: van den Hondel, C. A. M. J. J. & Punt, P. J. (1991) "Gene transfer systems and vector development for filamentous fungi", in: Applied Molecular Genetics of Fungi, J. F. Peberdy, et al., eds., pp. 1-28, Cambridge University Press: Cambridge.

Alternatively, insect cell expression vectors can also be advantageously utilized, e.g. for expression in Sf 9 cells. These are e.g. the vectors of the pAc series (Smith et al. (1983) Mol. Cell Biol. 3:2156-2165) and the pVL series (Lucklow and Summers (1989) Virology 170:31-39).

Furthermore, plant cells or algal cells can advantageously be used for gene expression. Examples of plant expression vectors may be found in Becker, D., et al. (1992) "New plant binary vectors with selectable markers located proximal to the left border", Plant Mol. Biol. 20: 1195-1197 or in Bevan, M. W. (1984) "Binary Agrobacterium vectors for plant transformation", Nucl. Acid. Res. 12: 8711-8721.

Furthermore, the nucleic acid sequences may also be expressed in mammalian cells, advantageously in nonhuman mammalian cells. Examples of corresponding expression vectors are pCDM8 and pMT2PC referred to in: Seed, B. (1987) Nature 329:840 or Kaufman et al. (1987) EMBO J. 6: 187-195). At the same time promoters preferred for use are of viral origin, such as by way of example promoters of polyoma, adenovirus 2, cytomegalovirus or simian virus 40. Other prokaryotic and eukaryotic expression systems are referred to in chapters 16 and 17 of Sambrook et al., Molecular Cloning: A Laboratory Manual. 2nd, ed., Cold Spring Harbor Laboratory, Cold Spring Harbor Laboratory Press, Cold Spring Harbor, N.Y., 1989.

In a preferred embodiment of the present invention, the SRPs are expressed in plants and plants cells such as unicellular plant cells (e.g. algae) (See Falciatore et al., 1999, Marine Biotechnology 1(3):239-251 and references therein) and plant cells from higher plants (e.g., the spermatophytes, such as crop plants). A SRP may be "introduced" into a plant cell by any means, including transfection, transformation or transduction, electroporation, particle bombardment, agroinfection, and the like. One transformation method known to those of skill in the art is the dipping of a flowering plant into an Agrobacteria solution, wherein the Agrobacteria contains the SRP nucleic acid, followed by breeding of the transformed gametes.

Other suitable methods for transforming or transfecting host cells including plant cells can be found in Sambrook, et al., Molecular Cloning: A Laboratory Manual. $2^{nd}$, ed., Cold Spring Harbor Laboratory, Cold Spring Harbor Laboratory Press, Cold Spring. Harbor, N.Y., 1989, and other laboratory manuals such as Methods in Molecular Biology, 1995, Vol. 44, Agrobacterium protocols, ed: Gartland and Davey, Humana Press, Totowa, N.J. As biotic and abiotic stress tolerance is a general trait wished to be inherited into a wide variety of plants like maize, wheat, rye, oat, triticale, rice, barley, soybean, peanut, cotton, rapeseed and canola, manihot, pepper, sunflower and tagetes, solanaceous plants like potato, tobacco, eggplant, and tomato, Vicia species, pea, alfalfa, bushy plants (coffee, cacao, tea), Salix species, trees (oil palm, coconut), perennial grasses, and forage crops, these crop plants are also preferred target plants for a genetic engineering as one further embodiment of the present invention. Forage crops include, but are not limited to, Wheatgrass, Canarygrass, Bromegrass, Wildrye Grass, Bluegrass, Orchardgrass, Alfalfa, Salfoin, Birdsfoot Trefoil, Alsike Clover, Red Clover, and Sweet Clover.

In one embodiment of the present invention, transfection of a SRP into a plant is achieved by Agrobacterium mediated gene transfer. Agrobacterium mediated plant transformation can be performed using for example the GV3101(pMP90) (Koncz and Schell, 1986, Mol. Gen. Genet. 204:383-396) or LBA4404 (Clontech) Agrobacterium tumefaciens strain. Transformation can be performed by standard transformation and regeneration techniques (Deblaere et al., 1994, Nucl. Acids Res. 13:4777-4788; Gelvin, Stanton B. and Schilperoort, Robert A, Plant Molecular Biology Manual, $2^{nd}$ Ed.—Dordrecht: Kluwer Academic Publ., 1995.—in Sect., Ringbuc Zentrale Signatur: BT11-P ISBN 0-7923-273'-4; Glick, Bernard R.; Thompson, John E., Methods in Plant Molecular Biology and Biotechnology, Boca Raton: CRC Press, 1993 360 S., ISBN 0-8493-5164-2). For example, rapeseed can be transformed via cotyledon or hypocotyl transformation (Moloney et al., 1989, Plant cell Report 8:238-242; De Block et al., 1989, Plant Physiol. 91:694-701). Use of antibiotics for Agrobacterium and plant selection depends on the binary vector and the Agrobacterium strain used for transformation. Rapeseed selection is normally performed using kanamycin as selectable plant marker. Agrobacterium mediated gene transfer to flax can be performed using, for example, a technique described by Mlynarova et al.; 1994, Plant Cell Report 13:282-285. Additionally, transformation of soybean can be performed using for example a technique described in European Patent No. 0424 047, U.S. Pat. No. 5,322,783, European Patent No. 0397 687, U.S. Pat. No. 5,376,543, or U.S. Pat. No. 5,169,770. Transformation of maize can be achieved by particle bombardment, polyethylene glycol mediated DNA uptake or via the silicon carbide fiber technique. (See, for example, Freeling and Walbot "The maize handbook" Springer Verlag: New York (1993) ISBN 3-540-97826-7). A specific example of maize transformation is found in U.S. Pat. No. 5,990,387, and a specific example of wheat transformation can be found in PCT Application No. WO 93/07256.

According to the present invention, the introduced SRP may be maintained in the plant cell stably if it is incorporated into a non-chromosomal autonomous replicon or integrated into the plant chromosomes. Alternatively, the introduced SRP may be present on an extra-chromosomal non-replicating vector and be transiently expressed or transiently active.

In one embodiment, a homologous recombinant microorganism can be created wherein the SRP is integrated into a chromosome, a vector is prepared which contains at least a portion of a SRP gene into which a deletion, addition, or substitution has been introduced to thereby alter, e.g., functionally disrupt, the SRP gene. Preferably, the SRP gene is a yeast, *E. coli, Brassica napus, Glycine max,* or *Oryza sativa* SRP gene, but it can be a homolog from a related plant or even from a mammalian or insect source. In one embodiment, the vector is designed such that, upon homologous recombination, the endogenous SRP gene is functionally disrupted (i.e., no longer encodes a functional polypeptide; also referred to as a knock-out vector). Alternatively, the vector can be designed such that, upon homologous recombination, the endogenous SRP gene is mutated or otherwise altered but still encodes a functional polypeptide (e.g., the upstream regulatory region can be altered to thereby alter the expression of the endogenous SRP). To create a point mutation via homologous recombination, DNA-RNA hybrids can be used in a technique known as chimeraplasty (Cole-Strauss et al., 1999, Nucleic Acids Research 27(5):1323-1330 and Kmiec, 1999 Gene therapy American Scientist. 87(3):240-247). Homologous recombination procedures in *Physcomitrella patens* are also well known in the art and are contemplated for use herein.

Whereas in the homologous recombination vector, the altered portion of the SRP gene is flanked at its 5' and 3' ends by an additional nucleic acid molecule of the SRP gene to allow for homologous recombination to occur between the exogenous SRP gene carried by the vector and an endogenous SRP gene, in a microorganism or plant. The additional flanking SRP nucleic acid molecule is of sufficient length for successful homologous recombination with the endogenous gene. Typically, several hundreds of base pairs up to kilobases of flanking DNA (both at the 5' and 3' ends) are included in the vector. See, e.g., Thomas, K. R., and Capecchi, M. R., 1987, Cell 51:503 for a description of homologous recombination vectors or Strepp et al., 1998, PNAS, 95 (8):4368-4373 for cDNA based recombination in *Physcomitrella patens*). The vector is introduced into a microorganism or plant cell (e.g., via polyethylene glycol mediated DNA), and cells in which the introduced PKSRP gene has homologously recombined with the endogenous PKSRP gene are selected using art-known techniques.

In another embodiment, recombinant microorganisms can be produced that contain selected systems which allow for regulated expression of the introduced gene. For example, inclusion of a SRP gene on a vector placing it under control of the lac operon permits expression of the SRP gene only in the presence of IPTG. Such regulatory systems are well known in the art.

Whether present in an extra-chromosomal non-replicating vector or a vector that is integrated into a chromosome, the SRP polynucleotide preferably resides in a plant expression cassette. A plant expression cassette preferably contains regulatory sequences capable of driving gene expression in plant cells that are operatively linked so that each sequence can fulfill its function, for example, termination of transcription by polyadenylation signals. Preferred polyadenylation signals are those originating from *Agrobacterium tumefaciens* t-DNA such as the gene 3 known as octopine synthase of the Ti-plasmid pTiACH5 (Gielen et al., 1984, EMBO J. 3:835) or functional equivalents thereof but also all other terminators functionally active in plants are suitable. As plant gene expression is very often not limited on transcriptional levels, a plant expression cassette preferably contains other operatively linked sequences like translational enhancers such as the overdrive-sequence containing the 5'-untranslated leader sequence from tobacco mosaic virus enhancing the polypeptide per RNA ratio (Gallie et al., 1987, Nucl. Acids Research 15:8693-8711). Examples of plant expression vectors include those detailed in: Becker, D. et al., 1992, New plant binary vectors with selectable markers located proximal to the left border, Plant Mol. Biol. 20: 1195-1197; and Bevan, M. W., 1984, Binary *Agrobacterium* vectors for plant transformation, Nucl. Acid. Res. 12:8711-8721; and Vectors for Gene Transfer in Higher Plants; in: Transgenic Plants, Vol. 1, Engineering and Utilization, eds.: Kung and R. Wu, Academic Press, 1993, S. 15-38.

"Transformation" is defined herein as a process for introducing heterologous DNA into a plant cell, plant tissue, or plant. It may occur under natural or artificial conditions using various methods well known in the art. Transformation may rely on any known method for the insertion of foreign nucleic acid sequences into aprokaryotic or eukaryotic host cell. The method is selected based on the host cell being transformed and may include, but is not limited to, viral infection, electroporation, lipofection, and particle bombardment. Such "transformed" cells include stably transformed cells in which the inserted DNA is capable of replication either as an autonomously replicating plasmid or as part of the host chromosome. They also include cells which transiently express the inserted DNA or RNA for limited periods of time. Transformed plant cells, plant tissue, or plants are understood to encompass not only the end product of a transformation process, but also transgenic progeny thereof.

The terms "transformed," "transgenic," and "recombinant" refer to a host organism such as a bacterium or a plant into which a heterologous nucleic acid molecule has been introduced. The nucleic acid molecule can be stably integrated into the genome of the host or the nucleic acid molecule can also be present as an extrachromosomal molecule. Such an extrachromosomal molecule can be auto-replicating. Transformed cells, tissues, or plants are understood to encompass not only the end product of a transformation process, but also transgenic progeny thereof. A "non-transformed," "non-transgenic," or "non-recombinant" host refers to a wild-type organism, e.g., a bacterium or plant, which does not contain the heterologous nucleic acid molecule.

A "transgenic plant", as used herein, refers to a plant which contains a foreign nucleotide sequence inserted into either its nuclear genome or organellar genome. It encompasses further the offspring generations i.e. the T1-, T2- and consecutively generations or BC1-, BC2- and consecutively generation as well as crossbreeds thereof with non-transgenic or other transgenic plants.

The host organism (=transgenic organism) advantageously contains at least one copy of the nucleic acid according to the invention and/or of the nucleic acid construct according to the invention.

In principle all plants can be used as host organism. Preferred transgenic plants are, for example, selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants such as plants advantageously selected from the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassaya, potato, sugarbeet, egg plant, alfalfa, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, dwarf bean, lupin, clover and Lucerne for mentioning only some of them.

In one prefered embodiment, the host plant is selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants and in particular plants mentioned herein above as host plants such as the families and genera mentioned above for example preferred the species *Anacardium occidentale, Calendula officinalis, Carthamus tinctorius, Cichorium intybus, Cynara scolymus, Helianthus annus, Tagetes lucida, Tagetes erecta, Tagetes tenuifolia; Daucus carota; Corylus avellana, Corylus colurna, Borago officinalis; Brassica napus, Brassica rapa* ssp., *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis, Brassica oleracea, Arabidopsis thaliana, Anana comosus, Ananas ananas, Bromelia comosa, Carica papaya, Cannabis sative, Ipomoea batatus, Ipomoea pandurata, Convolvulus batatas, Convolvulus tiliaceus, Ipomoea fastigiata, Ipomoea tiliacea, Ipomoea triloba, Convolvulus panduratus, Beta vulgaris, Beta vulgaris* var. *altissima, Beta vulgaris* var. *vulgaris, Beta maritima, Beta vulgaris* var. *perennis, Beta vulgaris* var. *conditiva, Beta vulgaris* var. *esculenta, Cucurbita maxima, Cucurbita mixta, Cucurbita pepo, Cucurbita moschata, Olea europaea, Manihot utilissima, Janipha manihot, Jatropha manihot, Manihot aipil, Manihot dulcis, Manihot manihot, Manihot melanobasis, Manihot esculenta, Ricinus communis, Pisum sativum, Pisum arvense, Pisum humile, Medicago sativa, Medicago falcata, Medicago varia, Glycine max Dolichos soja, Glycine gracilis, Glycine hispida, Phaseolus max, Soja hispida, Soja max, Cocos nucifera, Pelargonium grossularioides, Oleum cocoas, Laurus nobilis, Persea americana, Arachis hypogaea, Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense, Linum trigynum, Punica granatum, Gossypium hirsutum, Gossypium arboreum, Gossypium barbadense, Gossypium herbaceum, Gossypium thurberi, Musa nana, Musa acuminata, Musa paradisiaca, Musa* spp., *Elaeis guineensis, Papaver orientale, Papaver rhoeas, Papaver dubium, Sesamum indicum, Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata, Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum, Avena sativa, Avena fatua, Avena byzantina, Avena fatua* var. *sativa, Avena hybrida, Sorghum bicolor, Sorghum halepense, Sorghum saccharatum, Sorghum vulgare, Andropogon drummondi, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum, Zea mays, Triticum aestivum, Triticum durum, Triticum turgidum, Triticum hybemum, Triticum macha, Triticum sativum* or *Triticum vulgare, Cofea* spp., *Coffea arabica, Coffea canephora, Coffea liberica, Capsicum annuum, Capsicum annuum* var. *glabriusculum, Capsicum frutescens, Capsicum annuum, Nicotiana tabacum, Solanum tuberosum, Solanum melongena, Lycopersicon esculentum, Lycopersicon lycopersicum., Lycopersicon pyriforme, Solanum integrifolium, Solanum lycopersicum Theobroma cacao* or *Camellia sinensis.*

Anacardiaceae such as the genera *Pistacia, Mangifera, Anacardium* e.g. the species *Pistacia vera* [pistachios, Pistazie], *Mangifer indica* [Mango] or *Anacardium occidentale* [Cashew]; Asteraceae such as the genera *Calendula, Carthamus, Centaurea, Cichorium, Cynara, Helianthus, Lactuca, Locusta, Tagetes, Valeriana* e.g. the species *Calendula officinalis* [Marigold], *Carthamus tinctorius* [safflower], *Centaurea cyanus* [cornflower], *Cichorium intybus* [blue daisy], *Cynara scolymus* [Artichoke], *Helianthus annus* [sunflower], *Lactuca sativa, Lactuca crispa, Lactuca esculenta, Lactuca scariola* L. ssp. *sativa, Lactuca scariola* L. var. *integrata, Lactuca scariola* L. var. *integrifolia, Lactuca sativa* subsp. *romana, Locusta communis, Valeriana locusta* [lettuce], *Tagetes lucida, Tagetes erecta* or *Tagetes tenuifolia* [Marigold]; Apiaceae such as the genera *Daucus* e.g. the species *Daucus carota* [carrot]; Betulaceae such as the genera *Corylus* e.g. the species *Corylus avellana* or *Corylus colurna* [hazelnut]; Boraginaceae such as the genera *Borago* e.g. the species *Borago officinalis* [borage]; Brassicaceae such as the genera *Brassica, Melanosinapis, Sinapis, Arabadopsis* e.g. the species *Brassica napus, Brassica rapa* ssp. [canola, oilseed rape, turnip rape], *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis* [mustard], *Brassica oleracea* [fodder beet] or *Arabidopsis thaliana*; Bromeliaceae such as the genera *Anana, Bromelia* e.g. the species *Anana comosus, Ananas ananas* or *Bromelia comosa* [pineapple]; Caricaceae such as the genera *Carica* e.g. the species *Carica papaya* [papaya]; Cannabaceae such as the genera *Cannabis* e.g. the species *Cannabis sative* [hemp], Convolvulaceae such as the genera Ipomea, *Convolvulus* e.g. the species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* [sweet potato, Man of the Earth, wild potato], Chenopodiaceae such as the genera *Beta*, i.e. the species *Beta vulgaris, Beta vulgaris* var. *altissima, Beta vulgaris* var. *Vulgaris, Beta maritima, Beta vulgaris* var. *perennis, Beta vulgaris* var. *conditiva* or *Beta vulgaris* var. *esculenta* [sugar beet]; Cucurbitaceae such as the genera *Cucubita* e.g. the species *Cucurbita maxima, Cucurbita mixta, Cucurbita pepo* or *Cucurbita moschata* [pumpkin, squash]; Elaeagnaceae such as the genera *Elaeagnus* e.g. the species *Olea europaea* [olive]; Ericaceae such as the genera *Kalmia* e.g. the species *Kalmia latifolia, Kalmia angustifolia, Kalmia microphylla, Kalmia polifolia, Kalmia occidentalis, Cistus chamaerhodendros* or *Kalmia lucida* [American laurel, broad-leafed laurel, calico bush, spoon wood, sheep laurel, alpine laurel, bog laurel, western bog-laurel, swamp-laurel]; Euphorbiaceae such as the genera *Manihot, Janipha, Jatropha, Ricinus* e.g. the species *Manihot utilissima, Janipha manihot, Jatropha manihot, Manihot aipil, Manihot dulcis, Manihot manihot, Manihot melanobasis, Manihot esculenta* [manihot, arrowroot, tapioca, cassaya] or *Ricinus communis* [castor bean, Castor Oil Bush, Castor Oil Plant, Palma Christi. Wonder Tree]; Fabaceae such as the genera *Pisum, Albizia, Cathormion, Feuillea, Inga, Pithecolobium, Acacia, Mimosa, Medicajo, Glycine, Dolichos, Phaseolus, Soja* e.g. the species *Pisum sativum, Pisum arvense, Pisum humile* [pea], *Albizia berteriana, Albizia julibrissin, Albizia lebbeck, Acacia berteriana, Acacia littoralis, Albizia berteriana, Albizzia berteriana, Cathormion berteriana, Feuillea berteriana, Inga fragrans, Pithecellobium berterianum, Pithecellobium fragrans, Pithecolobium berterianum, Pseudalbizzia berteriana, Acacia julibrissin, Acacia nemu, Albizia* nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa [bastard logwood, silk tree, East Indian Walnut], Medicago sativa, Medicago falcata, Medicago varia [alfalfa] Glycine max Dolichos soja, Glycine gracilis, Glycine hispida, Phaseolus max, Soja hispida or Soja max [soybean]; Geraniaceae such as the genera Pelargonium, Cocos, Oleum e.g. the species Cocos nucifera, Pelargonium grossularioides or Oleum cocois [coconut]; Gramineae such as the genera Saccharum e.g. the species Saccharum officinarum; Juglandaceae such as the genera Juglans, Wallia e.g. the species Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans microcarpa, Juglans nigra or Wallia nigra [walnut, black walnut, common walnut, persian walnut, white walnut, butternut, black walnut]; Lauraceae such as the genera Persea, Laurus e.g. the species laurel Laurus nobilis [bay, laurel, bay laurel, sweet bay], Persea americana Persea americana, Persea gratissima or Persea persea [avocado]; Leguminosae such as the genera Arachis e.g. the species Arachis hypogaea [peanut]; Linaceae such as the genera Linum, Adenolinum e.g. the species Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne var. lewisii, Linum pratense or Linum trigynum [flax, linseed]; Lythrarieae such as the genera Punica e.g. the species Punica granatum [pomegranate]; Malvaceae such as the genera Gossypium e.g. the species Gossypium hirsutum, Gossypium arboreum, Gossypium barbadense, Gossypium herbaceum or Gossypium thurberi [cotton]; Musaceae such as the genera Musa e.g. the species Musa nana, Musa acuminata, Musa paradisiaca, Musa spp. [banana]; Onagraceae such as the genera Camissonia, Oenothera e.g. the species Oenothera biennis or Camissonia brevipes [primrose, evening primrose]; Palmae such as the genera Elacis e.g. the species Elaeis guineensis [oil plam]; Papaveraceae such as the genera Papaver e.g. the species Papaver orientale, Papaver rhoeas, Papaver dubium [poppy, oriental poppy, corn poppy, field poppy, shirley poppies, field poppy, long-headed poppy, longpod poppy]; Pedaliaceae such as the genera Sesamum e.g. the species Sesamum indicum [sesame]; Piperaceae such as the genera Piper, Artanthe, Peperomia, Steffensia e.g. the species Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata. [Cayenne pepper, wild pepper]; Poaceae such as the genera Hordeum, Secale, Avena, Sorghum, Andropogon, Holcus, Panicum, Oryza, Zea, Triticum e.g. the species Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum [barley, pearl barley, foxtail barley, wall barley, meadow barley], Secale cereale [rye], Avena sativa, Avena fatua, Avena byzantina, Avena fatua var. sativa, Avena hybrida [oat], Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondi, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum [Sorghum, millet], Oryza sativa, Oryza latifolia [rice], Zea mays [corn, maize] Triticum aestivum, Triticum durum, Triticum turgidum, Triticum hybernum, Triticum macha, Triticum sativum or Triticum vulgare [wheat, bread wheat, common wheat], Proteaceae such as the genera Macadamia e.g. the species Macadamia intergrifolia [macadamia]; Rubiaceae such as the genera Coffea e.g. the species Cofea spp., Coffea arabica, Coffea canephora or Coffea liberica [coffee]; Scrophulariaceae such as the genera Verbascum e.g. the species Verbascum blattaria, Verbascum chaixii, Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum or Verbascum thapsus [mullein, white moth mullein, nettle-leaved mullein, dense-flowered mullein, silver mullein, long-leaved mullein, white mullein, dark mullein, greek mullein, orange mullein, purple mullein, hoary mullein, great mullein]; Solanaceae such as the genera Capsicum, Nicotiana, Solanum, Lycopersicon e.g. the species Capsicum annuum, Capsicum annuum var. glabriusculum, Capsicum frutescens [pepper], Capsicum annuum [paprika], Nicotiana tabacum, Nicotiana alata, Nicotiana attenuata, Nicotiana glauca, Nicotiana langsdorffii, Nicotiana obtusifolia, Nicotiana quadrivalvis, Nicotiana repanda, Nicotiana rustica, Nicotiana sylvestris [tobacco], Solanum tuberosum [potato], Solanum melongena [eggplant] (Lycopersicon esculentum, Lycopersicon lycopersicum, Lycopersicon pyriforme, Solanum integrifolium or Solanum lycopersicum [tomato]; Sterculiaceae such as the genera Theobroma e.g. the species Theobroma cacao [cacao]; Theaceae such as the genera Camellia e.g. the species Camellia sinensis) [tea].

The introduction of the nucleic acids according to the invention, the expression cassette or the vector into organisms, plants for example, can in principle be done by all of the methods known to those skilled in the art. The introduction of the nucleic acid sequences gives rise to recombinant or transgenic organisms.

In the case of microorganisms, those skilled in the art can find appropriate methods in the textbooks by Sambrook, J. et al. (1989) Molecular cloning: A laboratory manual, Cold Spring Harbor Laboratory Press, by F. M. Ausubel et al. (1994) Current protocols in molecular biology, John Wiley and Sons, by D. M. Glover et al., DNA Cloning Vol. 1, (1995), IRL Press (ISBN 019-963476-9), by Kaiser et al. (1994) Methods in Yeast Genetics, Cold Spring Harbor Laboratory Press or Guthrie et al. Guide to Yeast Genetics and Molecular Biology, Methods in Enzymology, 1994, Academic Press.

The transfer of foreign genes into the genome of a plant is called transformation. In doing this the methods described for the transformation and regeneration of plants from plant tissues or plant cells are utilized for transient or stable transformation. Suitable methods are protoplast transformation by poly(ethylene glycol)-induced DNA uptake, the "biolistic" method using the gene cannon—referred to as the particle bombardment method, electroporation, the incubation of dry embryos in DNA solution, microinjection and gene transfer mediated by Agrobacterium. Said methods are described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector which is suitable for transforming Agrobacterium tumefaciens, for example pBin19 (Bevan et al., Nucl. Acids Res. 12 (1984) 8711).

*Agrobacteria* transformed by such a vector can then be used in known manner for the transformation of plants, in particular of crop plants such as by way of example tobacco plants, for example by bathing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

*Agrobacteria* transformed by an expression vector according to the invention may likewise be used in known manner for the transformation of plants such as test plants like *Arabidopsis* or crop plants such as cereal crops, corn, oats, rye, barley, wheat, soybean, rice, cotton, sugar beet, canola, sunflower, flax, hemp, potatoes, tobacco, tomatoes, carrots, paprika, oilseed rape, tapioca, cassava, arrowroot, tagetes, alfalfa, lettuce and the various tree, nut and vine species, in particular of oil-containing crop plants such as soybean, peanut, castor oil plant, sunflower, corn, cotton, flax, oilseed rape, coconut, oil palm, safflower (*Carthamus tinctorius*) or cocoa bean, e.g. by bathing bruised leaves or chopped leaves in an agrobacterial solution and then culturing them in suitable media.

The genetically modified plant cells may be regenerated by all of the methods known to those skilled in the art. Appropriate methods can be found in the publications referred to above by S. D. Kung and R. Wu, Potrykus or Höfgen and Willmitzer.

Accordingly, a further aspect of the invention relates to transgenic organisms transformed by at least one nucleic acid sequence, expression cassette or vector according to the invention as well as cells, cell cultures, tissue, parts—such as, for example, leaves, roots, etc. in the case of plant organisms—or reproductive material derived from such organisms. The terms "host organism", "host cell", "recombinant (host) organism" and "transgenic (host) cell" are used here interchangeably. Of course these terms relate not only to the particular host organism or the particular target cell but also to the descendants or potential descendants of these organisms or cells. Since, due to mutation or environmental effects certain modifications may arise in successive generations, these descendants need not necessarily be identical with the parental cell but nevertheless are still encompassed by the term as used here.

For the purposes of the invention "transgenic" or "recombinant" means with regard for example to a nucleic acid sequence, an expression cassette (=gene construct, nucleic acid construct) or a vector containing the nucleic acid sequence according to the invention or an organism transformed by the nucleic acid sequences, expression cassette or vector according to the invention all those constructions produced by genetic engineering methods in which either a) the nucleic acid sequence depicted in FIG. 1*a*, 1*b* or 1*c* or its derivatives or parts thereof or b) a genetic control sequence functionally linked to the nucleic acid sequence described under (a), for example a 3'- and/or 5'-genetic control sequence such as a promoter or terminator, or c) (a) and (b)

are not found in their natural, genetic environment or have been modified by genetic engineering methods, wherein the modification may by way of example be a substitution, addition, deletion, inversion or insertion of one or more nucleotide residues. Natural genetic environment means the natural genomic or chromosomal locus in the organism of origin or inside the host organism or presence in a genomic library. In the case of a genomic library the natural genetic environment of the nucleic acid sequence is preferably retained at least in part. The environment borders the nucleic acid sequence at least on one side and has a sequence length of at least 50 bp, preferably at least 500 bp, particularly preferably at least 1,000 bp, most particularly preferably at least 5,000 bp. A naturally occurring expression cassette—for example the naturally occurring combination of the natural promoter of the nucleic acid sequence according to the invention with the corresponding Δ-8-desaturase, Δ-9-elongase and/or Δ-5-desaturase gene—turns into a transgenic expression cassette when the latter is modified by unnatural, synthetic ("artificial") methods such as by way of example a mutagenation. Appropriate methods are described by way of example in U.S. Pat. No. 5,565,350 or WO 00/15815.

Suitable organisms or host organisms for the nucleic acid, expression cassette or vector according to the invention are advantageously in principle all organisms, which are suitable for the expression of recombinant genes as described above. Further examples which may be mentioned are plants such as *Arabidopsis*, Asteraceae such as *Calendula* or crop plants such as soybean, peanut, castor oil plant, sunflower, flax, corn, cotton, flax, oilseed rape, coconut, oil palm, safflower (*Carthamus tinctorius*) or cocoa bean.

A further object of the invention relates to the use of a nucleic acid construct, e.g. an expression cassette, containing DNA sequences encoding polypeptides of FIG. 1*a*, 1*b* or 1*c* or DNA sequences hybridizing therewith for the transformation of plant cells, tissues or parts of plants.

In doing so, depending on the choice of promoter, the sequences FIG. 1*a*, 1*b* or 1*c* can be expressed specifically in the leaves, in the seeds, the nodules, in roots, in the stem or other parts of the plant. Those transgenic plants overproducing sequences of FIG. 1*a*, 1*b* or 1*c*, the reproductive material thereof, together with the plant cells, tissues or parts thereof are a further object of the present invention.

The expression cassette or the nucleic acid sequences or construct according to the invention containing sequences of FIG. 1*a*, 1*b* or 1*c* can, moreover, also be employed for the transformation of the organisms identified by way of example above such as bacteria, yeasts, filamentous fungi and plants.

Within the framework of the present invention, altering metabolic activity means, for example, the artificially acquired trait of increased biosynthetic performance due to functional over expression of sequences of FIG. 1*a*, 1*b* or 1*c* in the organisms according to the invention, advantageously in the transgenic plants according to the invention, by comparison with the nongenetically modified initial plants at least for the duration of at least one plant generation.

A constitutive expression of the exogenous sequences of the FIG. 1*a*, 1*b* or 1*c* is, moreover, advantageous. On the other hand, however, an inducible expression may also appear desirable.

The efficiency of the expression of the sequences of the FIG. 1*a*, 1*b* or 1*c* can be determined, for example, in vitro by shoot meristem propagation. In addition, an expression of the sequences of FIG. 1*a*, 1*b* or 1*c* modified in nature and level and its effect on the metabolic pathways performance can be tested on test plants in greenhouse trials.

An additional object of the invention comprises transgenic organisms such as transgenic plants transformed by an expression cassette containing sequences of FIG. 1*a*, 1*b* or 1*c* according to the invention or DNA sequences hybridizing therewith, as well as transgenic cells, tissue, parts and reproduction material of such plants. Particular preference is given in this case to transgenic crop plants such as by way of example barley, wheat, rye, oats, corn, soybean, rice, cotton, sugar beet, oilseed rape and canola, sunflower, flax, hemp, thistle, potatoes, tobacco, tomatoes, tapioca, cassava, arrowroot, alfalfa, lettuce and the various tree, nut and vine species.

For the purposes of the invention plants are mono- and dicotyledonous plants, mosses or algae.

A further refinement according to the invention are transgenic plants as described above which contain a nucleic acid sequence or construct according to the invention or a expression cassette according to the invention.

Furthermore, by derivatives is meant homologues of the sequences of FIG. 1a, 1b or 1c, for example eukaryotic homologues, truncated sequences, single-stranded DNA of the encoding and nonencoding DNA sequence or RNA of the encoding and nonencoding DNA sequence.

In addition, by homologues of the sequences of FIG. 1a, 1b or 1c is meant derivatives such as by way of example promoter variants. These variants may be modified by one or more nucleotide exchanges, by insertion(s) and/or deletion(s) without, however, adversely affecting the functionality or efficiency of the promoters. Furthermore, the promoters can have their efficiency increased by altering their sequence or be completely replaced by more effective promoters even of foreign organisms.

By derivatives is also advantageously meant variants whose nucleotide sequence has been altered in the region from −1 to −2000 ahead of the start codon in such a way that the gene expression and/or the protein expression is modified, preferably increased. Furthermore, by derivatives is also meant variants which have been modified at the 3' end.

Suitable promoters in the expression cassette are in principle all promoters which can control the expression of foreign genes in organisms such as microorganisms like protozoa such as ciliates, algae such as green, brown, red or blue algae such as Euglena, bacteria such as gram-positive or gram-negative bacteria, yeasts such as *Saccharomyces, Pichia* or *Schizosaccharomyces* or fungi such as *Mortierella, Thraustochytrium* or *Schizochytrium* or plants, advantageously in plants or fungi. Use is preferably made in particular of plant promoters or promoters derived from a plant virus. Advantageous regulation sequences for the method according to the invention are found for example in promoters such as cos, tac, trp, tet, trp-tet, lpp, lac, lpp-lac, laclq-, T7, T5, T3, gal, trc, ara, SP6, λ-PR or in λ-PL promoters which are employed advantageously in gram-negative bacteria. Other advantageous regulation sequences are found, for example, in the gram-positive promoters amy and SPO2, in the yeast or fungal promoters ADC1, MFα, AC, P-60, CYC1, GAPDH, TEF, rp28, ADH or in the plant promoters CaMV/35S [Franck et al., Cell 21(1980) 285-294], SSU, OCS, lib4, STLS1, B33, nos (=Nopalin Synthase Promoter) or in the ubiquintin or phaseolin promoter. The expression cassette may also contain a chemically inducible promoter by means of which the expression of the exogenous sequences of the odd numbers of SEQ. ID No. 1-269 in the organisms can be controlled advantageously in the plants at a particular time. Advantageous plant promoters of this type are by way of example the PRP1 promoter [Ward et al., Plant. Mol. Biol. 22(1993), 361-366], a promoter inducible by benzenesulfonamide (EP 388 186), a promoter inducible by tetracycline [Gatz et al., (1992) Plant J. 2,397-404], a promoter inducible by salicylic acid (WO 95/19443), a promoter inducible by abscisic acid (EP 335 528) and a promoter inducible by ethanol or cyclohexanone (WO93/21334). Other examples of plant promoters which can advantageously be used are the promoter of cytosolic FBPase from potato, the ST-LSI promoter from potato (Stockhaus et al., EMBO J. 8 (1989) 2445-245), the promoter of phosphoribosyl pyrophosphate amidotransferase from *Glycine max* (see also gene bank accession number U87999) or a nodiene-specific promoter as described in EP 249 676. Particularly advantageous are those plant promoters which ensure expression in tissues or plant parts/organs in which fatty acid biosynthesis or the precursor stages thereof occurs, as in endosperm or in the developing embryo for example. Particularly noteworthy are advantageous promoters which ensure seed-specific expression such as by way of example the USP promoter or derivatives thereof, the LEB4 promoter, the phaseolin promoter or the napin promoter. The particularly advantageous USP promoter cited according to the invention or its derivatives mediate very early gene expression in seed development [Baeumlein et al., Mol Gen Genet, 1991, 225 (3): 459-67]. Other advantageous seed-specific promoters which may be used for monocotylodonous or dicotylodonous plants are the promoters suitable for dicotylodons such as napin gene promoters, likewise cited by way of example, from oilseed rape (U.S. Pat. No. 5,608,152), the oleosin promoter from *Arabidopsis* (WO 98/45461), the phaseolin promoter from *Phaseolus vulgaris* (U.S. Pat. No. 5,504,200), the Bce4 promoter from *Brassica* (WO 91/13980) or the leguminous B4 promoter (LeB4, Baeumlein et al., Plant J., 2, 2, 1992: 233-239) or promoters suitable for monocotylodons such as the promoters of the Ipt2 or Ipt1 gene in barley (WO 95/15389 and WO 95/23230) or the promoters of the barley hordeine gene, the rice glutelin gene, the rice oryzin gene, the rice prolamin gene, the wheat gliadin gene, the white glutelin gene, the corn zein gene, the oats glutelin gene, the sorghum kasirin gene or the rye secalin gene which are described in WO99/16890.

Furthermore, particularly preferred are those promoters, which ensure the expression in tissues, or plant parts in which, for example, the biosynthesis of fatty acids, oils and lipids or the precursor stages thereof takes place. Particularly noteworthy are promoters, which ensure a seed-specific expression. Noteworthy are the promoter of the napin gene from oilseed rape (U.S. Pat. No. 5,608,152), the USP promoter from *Vicia faba* (USP=unknown seed protein, Baeumlein et al., Mol Gen Genet, 1991, 225 (3): 459-67), the promoter of the oleosin gene from *Arabidopsis* (WO98/45461), the phaseolin promoter (U.S. Pat. No. 5,504,200) or the promoter of the legumin B4 gene (LeB4; Baeumlein et al., 1992, Plant Journal, 2 (2): 233-9). Other promoters to be mentioned are that of the Ipt2 or Ipt1 gene from barley (WO95/15389 and WO95/23230) which mediate seed-specific expression in monocotyledonous plants. Other advantageous seed specific promoters are promoters such as the promoters from rice, corn or wheat disclosed in WO 99/16890 or Amy32b, Amy6-6 or aleurain (U.S. Pat. No. 5,677,474), Bce4 (rape, U.S. Pat. No. 5,530, 149), glycinin (soy bean, EP 571 741), phosphoenol pyruvat carboxylase (soy bean, JP 06/62870), ADR12-2 (soy bean, WO 98/08962), isocitratlyase (rape, U.S. Pat. No. 5,689,040) or β-amylase (barley, EP 781 849).

As described above, the expression construct (=gene construct, nucleic acid construct) may contain yet other genes, which are to be introduced into the organisms. These genes can be subject to separate regulation or be subject to the same regulation region as sequences FIG. 1a, 1b or 1c. These genes are by way of example other bisynthesis genes, advantageously for fatty acid biosynthesis, vitamin biosynthesis etc. that allow increased synthesis.

In principle all natural promoters with their regulation sequences can be used like those named above for the expression cassette according to the invention and the method according to the invention. Over and above this, synthetic promoters may also advantageously be used.

In the preparation of an expression cassette various DNA fragments can be manipulated in order to obtain a nucleotide sequence, which usefully reads in the correct direction and is equipped with a correct reading raster. To connect the DNA fragments (=nucleic acids according to the invention) to one another adaptors or linkers may be attached to the fragments.

The promoter and the terminator regions can usefully be provided in the transcription direction with a linker or polylinker containing one or more restriction points for the insertion of this sequence. Generally, the linker has 1 to 10, mostly 1 to 8, preferably 2 to 6, restriction points. In general the size of the linker inside the regulatory region is less than 100 bp, frequently less than 60 bp, but at least 5 bp. The promoter may be both native or homologous as well as foreign or heterologous to the host organism, for example to the host plant. In the 5'-3' transcription direction the expression cassette contains the promoter, a DNA sequence which encodes of FIG. 1a, 1b or 1c gene and a region for transcription termination. Different termination regions can be exchanged for one another in any desired fashion.

Furthermore, manipulations which provide suitable restriction interfaces or which remove excess DNA or restriction interfaces can be employed. Where insertions, deletions or substitutions, such as transitions and transversions, come into consideration, in vitro mutagenesis, primer repair, restriction or ligation may be used. In suitable manipulations such as restriction, chewing back or filling of overhangs for blunt ends complementary ends of the fragments can be provided for the ligation.

For an advantageous high expression the attachment of the specific ER retention signal SEKDEL inter alia can be of importance (Schouten, A. et al., Plant Mol. Biol. 30 (1996), 781-792). In this way the average expression level is tripled or even quadrupled. Other retention signals which occur naturally in plant and animal proteins located in the ER may also be employed for the construction of the cassette. In another preferred embodiment a plastidial targeting sequence is used as described by Napier J. A. [Targeting of foreign proteins to the chloroplast, Methods Mol. Biol., 49, 1995: 369-376]. A preferred used vector comprising said plastidial targeting sequence is disclosed by Colin Lazarus [Guerineau F., Woolston S., Brooks L., Mullineaux P. "An expression cassette for targeting foreign proteins into chloroplast; Nucleic. Acids Res., Dec 9, 16 (23), 1988: 11380].

Preferred polyadenylation signals are plant polyadenylation signals, preferably those which substantially correspond to T-DNA polyadenylation signals from *Agrobacterium tumefaciens*, in particular gene 3 of the T-DNA (octopin synthase) of the Ti plasmid pTiACH5 (Gielen et al., EMBO J. 3 (1984), 835 et seq.) or corresponding functional equivalents.

An expression cassette is produced by fusion of a suitable promoter with suitable sequences of FIG. 1a, 1b or 1c together with a polyadenylation signal by common recombination and cloning techniques as described, for example, in T. Maniatis, E. F. Fritsch and J. Sambrook, Molecular Cloning: A Laboratory Manual, Cold Spring Harbor Laboratory, Cold Spring Harbor, N.Y. (1989) as well as in T. J. Silhavy, M. L. Berman and L. W. Enquist, Experiments with Gene Fusions, Cold Spring Harbor Laboratory, Cold Spring Harbor, N.Y. (1984) and in Ausubel, F. M. et al., Current Protocols in Molecular Biology, Greene Publishing Assoc. and Wiley-Interscience (1987).

In the preparation of an expression cassette various DNA fragments can be manipulated to produce a nucleotide sequence which usefully reads in the correct direction and is equipped with a correct reading raster. Adapters or linkers can be attached to the fragments for joining the DNA fragments.

The promoter and the terminator regions can usefully be provided in the transcription direction with a linker or polylinker containing one or more restriction points for the insertion of this sequence. Generally, the linker has 1 to 10, mostly 1 to 8, preferably 2 to 6, restriction points. In general the size of the linker inside the regulatory region is less than 100 bp, frequently less than 60 bp, but at least 5 bp. The promoter may be both native or homologous as well as foreign or heterologous to the host organism, for example to the host plant. In the 5'-3' transcription direction the expression cassette contains the promoter, a DNA sequence which either encodes gene of the odd numbers of SEQ. ID No. 1-269 and a region for transcription termination. Different termination regions can be exchanged for one another in any desired fashion.

In the preparation of an expression cassette various DNA fragments can be manipulated to produce a nucleotide sequence which usefully reads in the correct direction and is equipped with a correct reading raster. Adapters or linkers can be attached to the fragments for joining the DNA fragments.

The DNA sequences encoding the nucleic acid sequences used in the inventive processes such as the sequences of the FIG. 1a, 1b or 1c contain all the sequence characteristics needed to achieve correct localization of respective biosynthesis. Accordingly, no further targeting sequences are needed per se. However, such a localization may be desirable and advantageous and hence artificially modified or reinforced so that such fusion constructs are also a preferred advantageous embodiment of the invention.

Particularly preferred are sequences which ensure targeting in plastids. Under certain circumstances targeting into other compartments (reported in: Kermode, Crit. Rev. Plant Sci. 15, 4 (1996), 285-423) may also be desirable, e.g. into vacuoles, the mitochondrium, the endoplasmic reticulum (ER), peroxisomes, lipid structures or due to lack of corresponding operative sequences retention in the compartment of origin, the cytosol.

As used herein, the term "environmental stress" refers to any sub-optimal growing condition and includes, but is not limited to, sub-optimal conditions associated with salinity, drought, temperature, metal, chemical, pathogenic and oxidative stresses, or combinations thereof. In preferred embodiments, the environmental stress can be salinity, drought, heat, or low temperature, or combinations thereof, and in particular, can be low water content or low temperature. Wherein drought stress means any environmental stress which leads to a lack of water in plants or reduction of water supply to plants, wherein low temperature stress means freezing of plants below +4° C. as well as chilling of plants below 15° C. and wherein high temperature stress means for example a temperature above 35° C. The range of stress and stress response depends on the different plants which are used for the invention, i.e. it differs for example between a plant such as wheat and a plant such as *Arabidopsis*. A common response of plants to environmental stress is the loss of yield or the loss of quality. It is also to be understood that as used in the specification and in the claims, "a" or "an" can mean one or more, depending upon the context in which it is used. Thus, for example, reference to "a cell" can mean that at least one cell can be utilized.

As also used herein, the terms "nucleic acid" and "nucleic acid molecule" are intended to include DNA molecules (e.g., cDNA or genomic DNA) and RNA molecules (e.g., mRNA) and analogs of the DNA or RNA generated using nucleotide analogs. This term also encompasses untranslated sequence located at both the 3' and 5' ends of the coding region of the gene: at least about 1000 nucleotides of sequence upstream from the 5' end of the coding region and at least about 200 nucleotides of sequence downstream from the 3' end of the coding region of the gene. The nucleic acid molecule can be single-stranded or double-stranded, but preferably is double-stranded DNA.

An "isolated" nucleic acid molecule is one that is substantially separated from other nucleic acid molecules, which are present in the natural source of the nucleic acid. That means other nucleic acid molecules are present in an amount less than 5% based on weight of the amount of the desired nucleic acid, preferably less than 2% by weight, more preferably less than 1% by weight, most preferably less than 0.5% by weight. Preferably, an "isolated" nucleic acid is free of some of the sequences that naturally flank the nucleic acid (i.e., sequences located at the 5' and 3' ends of the nucleic acid) in the genomic DNA of the organism from which the nucleic acid is derived. For example, in various embodiments, the isolated stress related protein encoding nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived. Moreover, an "isolated" nucleic acid molecule, such as a cDNA molecule, can be free from some of the other cellular material with which it is naturally associated, or culture medium when produced by recombinant techniques, or chemical precursors or other chemicals when chemically synthesized.

A nucleic acid molecule of the present invention, e.g., a nucleic acid molecule encoding an SRP or a portion thereof which confers tolerance and/or resistance to environmental stress in plants, can be isolated using standard molecular biological techniques and the sequence information provided herein. For example, a Arabidopsis thaliana stress related protein encoding cDNA can be isolated from a A. thaliana c-DNA library using all or portion of one of the sequences of FIG. 1a, 1b or 1c. Moreover, a nucleic acid molecule encompassing all or a portion of one of the sequences of FIG. 1a, 1b or 1c can be isolated by the polymerase chain reaction using oligonucleotide primers designed based upon this sequence. For example, mRNA can be isolated from plant cells (e.g., by the guanidinium-thiocyanate extraction procedure of Chirgwin et al., 1979 Biochemistry 18:5294-5299) and cDNA can be prepared using reverse transcriptase (e.g., Moloney MLV reverse transcriptase, available from Gibco/BRL, Bethesda, Md.; or AMV reverse transcriptase, available from Seikagaku America, Inc., St. Petersburg, Fla.). Synthetic oligonucleotide primers for polymerase chain reaction amplification can be designed based upon one of the nucleotide sequences shown in FIG. 1a, 1b or 1c. A nucleic acid molecule of the invention can be amplified using cDNA or, alternatively, genomic DNA, as a template and appropriate oligonucleotide primers according to standard PCR amplification techniques. The nucleic acid molecule so amplified can be cloned into an appropriate vector and characterized by DNA sequence analysis. Furthermore, oligonucleotides corresponding to a SRP encoding nucleotide sequence can be prepared by standard synthetic techniques, e.g., using an automated DNA synthesizer.

In a preferred embodiment, an isolated nucleic acid molecule of the invention comprises one of the nucleotide sequences shown in sequences FIG. 1a, 1b or 1c encoding the SRP (i.e., the "coding region"), as well as 5' untranslated sequences and 3' untranslated sequences.

Moreover, the nucleic acid molecule of the invention can comprise only a portion of the coding region of one of the sequences of the nucleic acid of FIG. 1a, 1b or 1c, for example, a fragment which can be used as a probe or primer or a fragment encoding a biologically active portion of a SRP.

Portions of proteins encoded by the SRP encoding nucleic acid molecules of the invention are preferably biologically active portions described herein. As used herein, the term "biologically active portion of" a SRP is intended to include a portion, e.g., a domain/motif, of stress related protein that participates in a stress tolerance and/or resistance response in a plant. To determine whether a SRP, or a biologically active portion thereof, results in increased stress tolerance in a plant, a stress analysis of a plant comprising the SRP may be performed. Such analysis methods are well known to those skilled in the art, as detailed in the Examples. More specifically, nucleic acid fragments encoding biologically active portions of a SRP can be prepared by isolating a portion of one of the sequences of the nucleic acid of FIG. 1a, 1b or 1c expressing the encoded portion of the SRP or peptide (e.g., by recombinant expression in vitro) and assessing the activity of the encoded portion of the SRP or peptide.

Biologically active portions of a SRP are encompassed by the present invention and include peptides comprising amino acid sequences derived from the amino acid sequence of a SRP encoding gene, or the amino acid sequence of a protein homologous to a SRP, which include fewer amino acids than a full length SRP or the full length protein which is homologous to a SRP, and exhibits at least some enzymatic activity of a SRP. Typically, biologically active portions (e.g., peptides which are, for example, 5, 10, 15, 20, 30, 35, 36, 37, 38, 39, 40, 50, 100 or more amino acids in length) comprise a domain or motif with at least one activity of a SRP. Moreover, other biologically active portions in which other regions of the protein are deleted, can be prepared by recombinant techniques and evaluated for one or more of the activities described herein. Preferably, the biologically active portions of a SRP include one or more selected domains/motifs or portions thereof having biological activity.

The term "biological active portion" or "biological activity" means a SRP or a portion of a SRP which still has at least 10% or 20%, preferably 20%, 30%, 40 % or 50%, especially preferably 60%, 70% or 80% of the enzymatic activity of the natural or starting enzyme.

A nucleic acid molecule encompassing a complete sequence of the nucleic acid molecules used in the process, for example the polynucleotide of the invention, or a part thereof may additionally be isolated by polymerase chain reaction, oligonucleotide primers based on this sequence or on parts thereof being used. For example, a nucleic acid molecule comprising the complete sequence or part thereof can be isolated by polymerase chain reaction using oligonucleotide primers which have been generated on the basis of this sequence—For example, mRNA can be isolated from cells (for example by means of the guanidinium thiocyanate extraction method of Chirgwin et al. (1979) Biochemistry 18:5294-5299) and cDNA can be generated by means of reverse transcriptase (for example Moloney MLV reverse transcriptase, available from Gibco/BRL, Bethesda, Md., or AMV reverse transcriptase, obtainable from Seikagaku America, Inc., St. Petersburg, Fla.).

Synthetic oligonucleotide primers for the amplification, e.g. as shown in table 2, by means of polymerase chain reaction can be generated on the basis of a sequence shown herein, for example the sequence shown in FIG. 1a, 1b or 1c or the sequences derived from polypeptides as shown in FIG. 1a, 1b or 1c.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved region for the polypeptide of the invention are indicated in the alignment shown in the drawing. Conserved regions are those, which show a very little variation in the amino acid in one particular position of several homologs from different origin. The consensus sequences shown in FIG. 2 are derived from said alignments.

Degenerated primers can then be utilized by PCR for the amplification of fragments of novel proteins having abovementioned activity, e.g. having an SPR activity or further functional homologs of the polypeptide of the invention from other organisms.

These fragments can then be utilized as hybridization probe for isolating the complete gene sequence. As an alternative, the missing 5' and 3' sequences can be isolated by means of RACE-PCR (rapid amplification of cDNA ends). A nucleic acid molecule according to the invention can be amplified using cDNA or, as an alternative, genomic DNA as template and suitable oligonucleotide primers, following standard PCR amplification techniques. The nucleic acid molecule amplified thus can be cloned into a suitable vector and characterized by means of DNA sequence analysis. Oligonucleotides, which correspond to one of the nucleic acid molecules used in the process can be generated by standard synthesis methods, for example using an automatic DNA synthesizer.

Nucleic acid molecules which are advantageously for the process according to the invention can be isolated based on their homology to the nucleic acid molecules disclosed herein using the sequences or part thereof as hybridization probe and following standard hybridization techniques under stringent hybridization conditions. In this context, it is possible to use, for example, isolated nucleic acid molecules of at least 15, 20, 25, 30, 35, 40, 50, 60 or more nucleotides, preferably of at least 15, 20 or 25 nucleotides in length which hybridize under stringent conditions with the above-described nucleic acid molecules, in particular with those which encompass a nucleotide sequence of the nucleic acid molecule used in the process of the invention or encoding a protein used in the invention or of the nucleic acid molecule of the invention. Nucleic acid molecules with 30, 50, 100, 250 or more nucleotides may also be used.

In addition to fragments of the SRP described herein, the present invention includes homologs and analogs of naturally occurring SRP and SRP encoding nucleic acids in a plant.

"Homologs" are defined herein as two nucleic acids or proteins that have similar, or "homologous", nucleotide or amino acid sequences, respectively. Homologs include allelic variants, orthologs, paralogs, agonists and antagonists of SRP as defined hereafter. The term "homolog" further encompasses nucleic acid molecules that differ from one of the nucleotide sequences as the polynucleotide as shown in FIG. 1a, 1b or 1c (and portions thereof) due to degeneracy of the genetic code and thus encode the same SRP as that encoded by the amino acid sequences as the polypeptide as shown in FIG. 1a, 1b or 1c. As used herein a "naturally occurring" SRP refers to a SRP amino acid sequence that occurs in nature.

The term "homology" means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other plant varieties or species, or mutations. These mutations may occur naturally or may be obtained by mutagenesis techniques. The allelic variations may be naturally occurring allelic variants as well as synthetically produced or genetically engineered variants. Structurally equivalents can, for example, be identified by testing the binding of said polypeptide to antibodies or computer based predictions. Structurally equivalent have the similar immunological characteristic, e.g. comprise similar epitopes.

Functional equivalents derived from one of the polypeptides as shown in any sequence according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in FIG. 1a, 1b or 1c according to the invention and are distinguished by essentially the same properties as the polypeptide as shown in FIG. 1a, 1b or 1c.

Functional equivalents derived from the nucleic acid sequence as shown in any sequence according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in FIG. 1a, 1b or 1c according to the invention and encode polypeptides having essentially the same properties as the polypeptide as shown in FIG. 1a, 1b or 1c.

"Essentially the same properties" of a functional equivalent is above all understood as meaning that the functional equivalent has above mentioned activity, e.g conferring an increase in the fine chemical amount while increasing the amount of protein, activity or function of said functional equivalent in an organism, e.g. a micororganism, a plant or plant or animal tissue, plant or animal cells or a part of the same.

By "hybridizing" it is meant that such nucleic acid molecules hybridize under conventional hybridization conditions, preferably under stringent conditions such as described by, e.g., Sambrook (Molecular Cloning; A Laboratory Manual, 2nd Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6.

According to the invention, DNA as well as RNA molecules of the nucleic acid of the invention can be used as probes. Further, as template for the identification of functional homologues Northern blot assays as well as Southern blot assays can be performed. The Northern blot assay advantageously provides further informations about the expressed gene product: e.g. expression pattern, occurrence of processing steps, like splicing and capping, etc. The Southern blot assay provides additional information about the chromosomal localization and organization of the gene encoding the nucleic acid molecule of the invention.

A preferred, nonlimiting example of stringent hybridization conditions are hybridizations in 6× sodium chloride/sodium citrate (=SSC) at approximately 45° C., followed by one or more wash steps in 0.2×SSC, 0.1% SDS at 50 to 65° C., for example at 50° C., 55° C. or 60° C. The skilled worker knows that these hybridization conditions differ as a function of the type of the nucleic acid and, for example when organic solvents are present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1×0.5×, 1×, 2×, 3×, 4× or 5×SSC (pH 7.2). If organic solvent(s) is/are present in the abovementioned buffer, for example 50% formamide, the temperature under standard conditions is approximately 40° C., 42° C. or 45° C. The hybridization conditions for DNA:DNA hybrids are preferably for example 0.1×SSC and 20° C., 25° C., 30° C., 35° C., 40° C. or 45° C., preferably between 30° C. and 45° C. The hybridization conditions for DNA:RNA hybrids are preferably for example 0.1×SSC and 30° C., 35° C., 40° C., 45° C., 50° C. or 55° C., preferably between 45° C. and 55° C. The abovementioned hybridization temperatures are determined for example for a nucleic acid approximately 100 bp (=base pairs) in length and a G+C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 0.2× SSC at 50° C., preferably at 65° C.) (20×SSC: 0.3M sodium citrate, 3M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied. Denaturants, for example formamide or SDS, may also be employed during the hybridization. In the presence of 50% formamide, hybridization is preferably effected at 42° C. Relevant factors like i) length of treatment, ii) salt conditions, iii) detergent conditions, iv) competitor DNAs, v) temperature and vi) probe selection can be combined case by case so that not all possibilities can be mentioned herein.

Thus, in a preferred embodiment, Northern blots are prehybridized with Rothi-Hybri-Quick buffer (Roth, Karlsruhe) at 68° C. for 2 h. Hybridzation with radioactive labelled probe is done overnight at 68° C. Subsequent washing steps are performed at 68° C. with 1×SSC.

For Southern blot assays the membrane is prehybridized with Rothi-Hybri-Quick buffer (Roth, Karlsruhe) at 68° C. for 2 h. The hybridzation with radioactive labelled probe is conducted over night at 68° C. Subsequently the hybridization buffer is discarded and the filter shortly washed using 2×SSC; 0.1% SDS. After discarding the washing buffer new 2×SSC; 0.1% SDS buffer is added and incubated at 68° C. for 15 minutes. This washing step is performed twice followed by an additional washing step using 1×SSC; 0.1% SDS at 68° C. for 10 min.

Some further examples of conditions for DNA hybridization (Southern blot assays) and wash step are shown hereinbelow:

(1) Hybridization conditions can be selected, for example, from the following conditions:
   a) 4×SSC at 65° C.,
   b) 6×SSC at 45° C.,
   c) 6×SSC, 100 mg/ml denatured fragmented fish sperm DNA at 68° C.,
   d) 6×SSC, 0.5% SDS, 100 mg/ml denatured salmon sperm DNA at 68° C.,
   e) 6×SSC, 0.5% SDS, 100 mg/ml denatured fragmented salmon sperm DNA, 50% formamide at 42° C.,
   f) 50% formamide, 4×SSC at 42° C.,
   g) 50% (vol/vol) formamide, 0.1% bovine serum albumin, 0.1% Ficoll, 0.1% polyvinylpyrrolidone, 50 mM sodium phosphate buffer pH 6.5, 750 mM NaCl, 75 mM sodium citrate at 42° C.,
   h) 2× or 4×SSC at 50° C. (low-stringency condition), or
   i) 30 to 40% formamide, 2× or 4×SSC at 42° C. (low-stringency condition).

(2) Wash steps can be selected, for example, from the following conditions:
   a) 0.015 M NaCl/0.0015 M sodium citrate/0.1% SDS at 50° C.
   b) 0.1×SSC at 65° C.
   c) 0.1×SSC, 0.5% SDS at 68° C.
   d) 0.1×SSC, 0.5% SDS, 50% formamide at 42° C.
   e) 0.2×SSC, 0.1% SDS at 42° C.
   f) 2×SSC at 65° C. (low-stringency condition).

In an other embodiment is meant by standard conditions, for example, depending on the nucleic acid in question temperatures between 42° C. and 58° C. in an aqueous buffer solution having a concentration of between 0.1 and 5×SSC (1×SSC=0.15 M NaCl, 15 mM sodium citrate, pH 7.2) or additionally in the presence of 50% formamide, such as by way of example 42° C. in 5×SSC, 50% formamide. Hybridization conditions for DNA:DNA hybrids are advantageously 0.1×SSC and temperatures between approximately 20° C. and 45° C., preferably between approximately 30° C. and 45° C. For DNA:RNA hybrids the hybridization conditions are advantageously 0.1×SSC and temperatures between approximately 30° C. and 55° C., preferably between approximately 45° C. and 55° C. These specified temperatures for hybridization are melting temperature values calculated by way of example for a nucleic acid having a length of approximately 100 nucleotides and a G+C content of 50% in the absence of formamide. The experimental conditions for DNA hybridization are described in relevant genetics textbooks such as by way of example Sambrook et al., "Molecular Cloning", Cold Spring Harbor Laboratory, 1989, and may be calculated by formulae known to those skilled in the art, for example as a function of the length of the nucleic acids, the nature of the hybrids or the G+C content. Those skilled in the art may draw on the following textbooks for further information on hybridization: Ausubel et al. (eds), 1985, Current Protocols in Molecular Biology, John Wiley & Sons, New York; Hames and Higgins (eds), 1985, Nucleic Acids Hybridization: A Practical Approach, IRL Press at Oxford University Press, Oxford; Brown (ed), 1991, Essential Molecular Biology: A Practical Approach, IRL Press at Oxford University Press, Oxford.

Polypeptides having above-mentioned activity, i.e. conferring the altered metabolic activity, derived from other organisms, can be encoded by other DNA sequences which hybridize to the sequences shown in FIG. 1a, 1b or 1c under relaxed hybridization conditions and which code on expression for peptides conferring an altered metabolic activity.

Further, some applications have to be performed at low stringency hybridisation conditions, without any consequences for the specificity of the hybridisation. For example, a Southern blot analysis of total DNA could be probed with a nucleic acid molecule of the present invention and washed at low stringency (55° C. in 2×SSPE0.1% SDS). The hybridisation analysis could reveal a simple pattern of only genes encoding polypeptides of the present invention or used in the process of the invention, e.g. having herein-mentioned activity of increasing the fine chemical. A further example of such low-stringent hybridization conditions is 4×SSC at 50° C. or hybridization with 30 to 40% formamide at 42° C. Such molecules comprise those which are fragments, analogues or derivatives of the polypeptide of the invention or used in the process of the invention and differ, for example, by way of amino acid and/or nucleotide deletion(s), insertion(s), substitution (s), addition(s) and/or recombination (s) or any other modification(s) known in the art either alone or in combination from the above-described amino acid sequences or their underlying nucleotide sequence(s). However, it is preferred to use high stringency hybridisation conditions.

Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, 25 or 30 bp. Preferably are also hybridizations with at least 100 bp or 200, very especially preferably at least 400 bp in length. In an especially preferred embodiment, the hybridization should be carried out with the entire nucleic acid sequence with conditions described above.

The terms "fragment", "fragment of a sequence" or "part of a sequence" mean a truncated sequence of the original sequence referred to. The truncated sequence (nucleic acid or protein sequence) can vary widely in length; the minimum size being a sequence of sufficient size to provide a sequence with at least a comparable function and/or activity of the original sequence referred to or hybridizing with the nucleic acid molecule of the invention or used in the process of the invention under stringent conditions, while the maximum size is not critical. In some applications, the maximum size usually is not substantially greater than that required to provide the desired activity and/or function(s) of the original sequence.

In addition to fragments and fusion polypeptides of the SRPs described herein, the present invention includes homologs and analogs of naturally occurring SRPs and SRP encoding nucleic acids in a plant. "Homologs" are defined herein as two nucleic acids or polypeptides that have similar, or substantially identical, nucleotide or amino acid sequences, respectively. Homologs include allelic variants, orthologs, paralogs, agonists and antagonists of SRPs as defined hereafter. The term "homolog" further encompasses nucleic acid molecules that differ from one of the nucleotide sequences shown in FIG. 1a, 1b or 1c (and portions thereof) due to degeneracy of the genetic code and thus encode the same SRP as that encoded by the nucleotide sequences shown in FIG. 1a, 1b or 1c. As used herein a "naturally occurring" SRP refers to a SRP amino acid sequence that occurs in nature. Preferably, a naturally occurring SRP comprises an amino acid sequence selected from the group consisting of polypeptides of FIG. 1a, 1b or 1c.

An agonist of the SRP can retain substantially the same, or a subset, of the biological activities of the SRP. An antagonist of the SRP can inhibit one or more of the activities of the naturally occurring form of the SRP. For example, the SRP antagonist can competitively bind to a downstream or upstream member of the cell membrane component metabolic cascade that includes the SRP, or bind to a SRP that mediates transport of compounds across such membranes, thereby preventing translocation from taking place.

Nucleic acid molecules corresponding to natural allelic variants and analogs, orthologs and paralogs of a SRP cDNA can be isolated based on their identity to the *Saccharomyces cerevisiae, E. coli, Brassica napus, Glycine max*, or *Oryza sativa* SRP nucleic acids described herein using SRP cDNAs, or a portion thereof, as a hybridization probe according to standard hybridization techniques under stringent hybridization conditions. In an alternative embodiment, homologs of the SRP can be identified by screening combinatorial libraries of mutants, e.g., truncation mutants, of the SRP for SRP agonist or antagonist activity. In one embodiment, a variegated library of SRP variants is generated by combinatorial mutagenesis at the nucleic acid level and is encoded by a variegated gene library. A variegated library of SRP variants can be produced by, for example, enzymatically ligating a mixture of synthetic oligonucleotides into gene sequences such that a degenerate set of potential SRP sequences is expressible as individual polypeptides, or alternatively, as a set of larger fusion polypeptides (e.g., for phage display) containing the set of SRP sequences therein. There are a variety of methods that can be used to produce libraries of potential SRP homologs from a degenerate oligonucleotide sequence. Chemical synthesis of a degenerate gene sequence can be performed in an automatic DNA synthesizer, and the synthetic gene is then ligated into an appropriate expression vector. Use of a degenerate set of genes allows for the provision, in one mixture, of all of the sequences encoding the desired set of potential SRP sequences. Methods for synthesizing degenerate oligonucleotides are known in the art. See, e.g., Narang, S. A., 1983, Tetrahedron 39:3; Itakura et al., 1984, Annu. Rev. Biochem. 53:323; Itakura et al., 1984, Science 198:1056; Ike et al., 1983, Nucleic Acid Res. 11:477.

In addition, libraries of fragments of the SRP coding regions can be used to generate a variegated population of SRP fragments for screening and subsequent selection of homologs of a SRP. In one embodiment, a library of coding sequence fragments can be generated by treating a double stranded PCR fragment of a SRP coding sequence with a nuclease under conditions wherein nicking occurs only about once per molecule, denaturing the double stranded DNA, renaturing the DNA to form double stranded DNA, which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal, and internal fragments of various sizes of the SRP.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of SRP homologs. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique that enhances the frequency of functional mutants in the libraries, can be used in combination with the screening assays to identify SRP homologs (Arkin and Yourvan, 1992, PNAS 89:7811-781,5; Delgrave et al., 1993, Polypeptide Engineering 6(3):327-331). In another embodiment, cell based assays can be exploited to analyze a variegated SRP library, using methods well known in the art. The present invention further provides a method of identifying a novel SRP, comprising (a) raising a specific antibody response to a SRP, or a fragment thereof, as described herein; (b) screening putative SRP material with the antibody, wherein specific binding of the antibody to the material indicates the presence of a potentially novel SRP; and (c) analyzing the bound material in comparison to known SRP, to determine its novelty.

As stated above, the present invention includes SRPs and homologs thereof. To determine the percent sequence identity of two amino acid sequences (e.g., one of the sequences of FIG. 1a, 1b or 1c, and a mutant form thereof), the sequences are aligned for optimal comparison purposes (e.g., gaps can be introduced in the sequence of one polypeptide for optimal alignment with the other polypeptide or nucleic acid). The amino acid residues at corresponding amino acid positions are then compared. When a position in one sequence (e.g., one of the sequences of FIG. 1a, 1b or 1c) is occupied by the same amino acid residue as the corresponding position in the other sequence (e.g., a mutant form of the sequence selected from the polypeptide of FIG. 1a, 1b or 1c), then the molecules are identical at that position. The same type of comparison can be made between two nucleic acid sequences.

The percent sequence identity between the two sequences is a function of the number of identical positions shared by the sequences (i.e., percent sequence identity=numbers of identical positions/total numbers of positions×100). Preferably, the isolated amino acid homologs included in the present invention are at least about 50-60%, preferably at least about 60-70%, and more preferably at least about 70-75%, 75-80%, 80-85%, 85-90% or 90-95%, and most preferably at least about 96%, 97%, 98%, 99% or more identical to an entire amino acid sequence shown in FIG. 1a, 1b or 1c. In yet another embodiment, the isolated amino acid homologs included in the present invention are at least about 50-60%, preferably at least about 60-70%, and more preferably at least about 70-75%, 75-80%, 80-85%, 85-90% or 90-95%, and most preferably at least about 96%, 97%, 98%, 99% or more identical to an entire amino acid sequence encoded by a nucleic acid sequence shown in FIG. 1a, 1b or 1c. In other embodiments, the SRP amino acid homologs have sequence identity over at least 15 contiguous amino acid residues, more preferably at least 25 contiguous amino acid residues, and most preferably at least 35 contiguous amino acid residues of FIG. 1a, 1b or 1c.

In another preferred embodiment, an isolated nucleic acid homolog of the invention comprises a nucleotide sequence which is at least about 50-60%, preferably at least about 60-70%, more preferably at least about 70-75%, 75-80%, 80-85%, 85-90% or 90-95%, and even more preferably at least about 95%, 96%, 97%, 98%, 99% or more identical to a nucleotide sequence shown FIG. 1a, 1b or 1c, or to a portion comprising at least 20, 30, 40, 50, 60 consecutive nucleotides thereof. The preferable length of sequence comparison for nucleic acids is at least 75 nucleotides, more preferably at least 100 nucleotides and most preferably the entire length of the coding region.

It is further preferred that the isolated nucleic acid homolog of the invention encodes a SRP, or portion thereof, that is at least 85% identical to an amino acid sequence of FIG. 1a, 1b or 1c and that functions as a modulator of an environmental stress response in a plant. In a more preferred embodiment, overexpression of the nucleic acid homolog in a plant increases the tolerance of the plant to an environmental stress.

For the purposes of the invention, the percent sequence identity between two nucleic acid or polypeptide sequences is determined using the Vector NTI 6.0 (PC) software package (InforMax, 7600 Wisconsin Ave., Bethesda, Md. 20814). A gap opening penalty of 15 and a gap extension penalty of 6.66 are used for determining the percent identity of two nucleic acids. A gap opening penalty of 10 and a gap extension penalty of 0.1 are used for determining the percent identity of two polypeptides. All other parameters are set at the default settings. For purposes of a multiple alignment (Clustal W algorithm), the gap opening penalty is 10, and the gap extension penalty is 0.05 with blosum62 matrix. It is to be understood that for the purposes of determining sequence identity when comparing a DNA sequence to an RNA sequence, a thymidine nucleotide is equivalent to a uracil nucleotide.

In another aspect, the invention provides an isolated nucleic acid comprising a polynucleotide that hybridizes to the polynucleotide of FIG. 1a, 1b or 1c under stringent conditions. More particularly, an isolated nucleic acid molecule of the invention is at least 15 nucleotides in length and hybridizes under stringent conditions to the nucleic acid molecule comprising a nucleotide sequence of FIG. 1a, 1b or 1c. In other embodiments, the nucleic acid is at least 30, 50, 100, 250 or more nucleotides in length. Preferably, an isolated nucleic acid homolog of the invention comprises a nucleotide sequence which hybridizes under highly stringent conditions to the nucleotide sequence shown in FIG. 1a, 1b or 1c, and functions as a modulator of stress tolerance in a plant. In a further preferred embodiment, overexpression of the isolated nucleic acid homolog in a plant increases a plant's tolerance to an environmental stress.

As used herein with regard to hybridization for DNA to DNA blot, the term "stringent conditions" refers in one embodiment to hybridization overnight at 60° C. in 10× Denharts solution, 6×SSC, 0.5% SDS and 100 μg/ml denatured salmon sperm DNA. Blots are washed sequentially at 62° C. for 30 minutes each time in 3×SSC/0.1% SDS, followed by 1×SSC/0.1% SDS and finally 0.1×SSC/0.1% SDS. As also used herein, "highly stringent conditions" refers to hybridization overnight at 65° C. in 10× Denharts solution, 6×SSC, 0.5% SDS and 100 μg/ml denatured salmon sperm DNA. Blots are washed sequentially at 65° C. for 30 minutes each time in 3×SSC/0.1% SDS, followed by 1×SSC/0.1% SDS and finally 0.1×SSC/0.1% SDS. Methods for nucleic acid hybridizations are described in Meinkoth and Wahl, 1984, Anal. Biochem. 138:267-284; Ausubel et al. eds, 1995, Current Protocols in Molecular Biology, Chapter 2, Greene Publishing and Wiley-Interscience, New York; and Tijssen, 1993, Laboratory Techniques in Biochemistry and Molecular Biology: Hybridization with Nucleic Acid Probes, Part I, Chapter 2, Elsevier, N.Y. Preferably, an isolated nucleic acid molecule of the invention that hybridizes under stringent or highly stringent conditions to a sequence of FIG. 1a, 1b or 1c corresponds to a naturally occurring nucleic acid molecule. As used herein, a "naturally occurring" nucleic acid molecule refers to an RNA or DNA molecule having a nucleotide sequence that occurs in nature (e.g., encodes a natural polypeptide). In one embodiment, the nucleic acid encodes a naturally occurring *Saccharomyces cerevisiae, E. coli, Brassica napus, Glycine max,* or *Oryza sativa* SRP.

Using the above-described methods, and others known to those of skill in the art, one of ordinary skill in the art can isolate homologs of the SRPs comprising amino acid sequences shown in FIG. 1a, 1b or 1c. One subset of these homologs are allelic variants. As used herein, the term "allelic variant" refers to a nucleotide sequence containing polymorphisms that lead to changes in the amino acid sequences of a SRP and that exist within a natural population (e.g., a plant species or variety). Such natural allelic variations can typically result in 1-5% variance in a SRP nucleic acid. Allelic variants can be identified by sequencing the nucleic acid sequence of interest in a number of different plants, which can be readily carried out by using hybridization probes to identify the same SRP genetic locus in those plants. Any and all such nucleic acid variations and resulting amino acid polymorphisms or variations in a SRP that are the result of natural allelic variation and that do not alter the functional activity of a SRP, are intended to be within the scope of the invention.

An isolated nucleic acid molecule encoding a SRP having sequence identity with a polypeptide sequence of FIG. 1a, 1b or 1c can be created by introducing one or more nucleotide substitutions, additions or deletions into a nucleotide sequence of FIG. 1a, 1b or 1c, respectively, such that one or more amino acid substitutions, additions, or deletions are introduced into the encoded polypeptide. Mutations can be introduced into one of the sequences of FIG. 1a, 1b or 1c by standard techniques, such as site-directed mutagenesis and PCR-mediated mutagenesis. Preferably, conservative amino acid substitutions are made at one or more predicted nonessential amino acid residues. A "conservative amino acid substitution" is one in which the amino acid residue is replaced with an amino acid residue having a similar side chain.

Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in a SRP is preferably replaced with another amino acid residue from the same side chain family. Alternatively, in another embodiment, mutations can be introduced randomly along all or part of a SRP coding sequence, such as by saturation mutagenesis, and the resultant mutants can be screened for a SRP activity described herein to identify mutants that retain SRP activity. Following mutagenesis of one of the sequences of the invention, the encoded polypeptide can be expressed recombinantly and the activity of the polypeptide can be determined by analyzing the stress tolerance of a plant expressing the polypeptide as described herein.

Additionally, optimized SRP nucleic acids can be created. As used herein, "optimized" refers to a nucleic acid that is genetically engineered to increase its expression in a given plant or animal. To provide plant optimized SRP nucleic acids, the DNA sequence of the gene can be modified to 1) comprise codons preferred by highly expressed plant genes; 2) comprise an A+T content in nucleotide base composition to that substantially found in plants; 3) form a plant initiation sequence; or 4) eliminate sequences that cause destabilization, inappropriate polyadenylation, degradation, and termination of RNA, or that form secondary structure hairpins or RNA splice sites. Increased expression of SRP nucleic acids in plants can be achieved by utilizing the distribution frequency of codon usage in plants in general or a particular plant. Methods for optimizing nucleic acid expression in plants can be found in EPA 0359472; EPA 0385962; PCT Application No. WO 91/16432; U.S. Pat. No. 5,380,831; U.S. Pat. No. 5,436,391; Perlack et al., 1991, Proc. Natl. Acad. Sci. USA 88:3324-3328; and Murray et al., 1989, Nucleic Acids Res. 17:477-498.

As used herein, "frequency of preferred codon usage" refers to the preference exhibited by a specific host cell in usage of nucleotide codons to specify a given amino acid. To determine the frequency of usage of a particular codon in a gene, the number of occurrences of that codon in the gene is divided by the total number of occurrences of all codons specifying the same amino acid in the gene. Similarly, the frequency of preferred codon usage exhibited by a host cell can be calculated by averaging frequency of preferred codon usage in a large number of genes expressed by the host cell. It is preferable that this analysis be limited to genes that are highly expressed by the host cell. The percent deviation of the frequency of preferred codon usage for a synthetic gene from that employed by a host cell is calculated first by determining the percent deviation of the frequency of usage of a single codon from that of the host cell followed by obtaining the average deviation over all codons. As defined herein, this calculation includes unique codons (i.e., ATG and TGG). In general terms, the overall average deviation of the codon usage of an optimized gene from that of a host cell is calculated using the equation $1A = n = 1\ Z\ X_n - Y_n X_n$ times 100 Z where $X_n$=frequency of usage for codon n in the host cell; $Y_n$=frequency of usage for codon n in the synthetic gene; n represents an individual codon that specifies an amino acid; and the total number of codons is Z. The overall deviation of the frequency of codon usage, A, for all amino acids should preferably be less than about 25%, and more preferably less than about 10%.

Hence, a SRP nucleic acid can be optimized such that its distribution frequency of codon usage deviates, preferably, no more than 25% from that of highly expressed plant genes and, more preferably, no more than about 10%. In addition, consideration is given to the percentage G+C content of the degenerate third base (monocotyledons appear to favor G+C in this position, whereas dicotyledons do not). It is also recognized that the XCG (where X is A, T, C, or G) nucleotide is the least preferred codon in dicots whereas the XTA codon is avoided in both monocots and dicots. Optimized SRP nucleic acids of this invention also preferably have CG and TA doublet avoidance indices closely approximating those of the chosen host plant (i.e., *Brassica napus, Glycine max*, or *Oryza sativa*). More preferably these indices deviate from that of the host by no more than about 10-15%.

In addition to the nucleic acid molecules encoding the SRPs described above, another aspect of the invention pertains to isolated nucleic acid molecules that are antisense thereto. Antisense polynucleotides are thought to inhibit gene expression of a target polynucleotide by specifically binding the target polynucleotide and interfering with transcription, splicing, transport, translation, and/or stability of the target polynucleotide. Methods are described in the prior art for targeting the antisense polynucleotide to the chromosomal DNA, to a primary RNA transcript, or to a processed mRNA. Preferably, the target regions include splice sites, translation initiation codons, translation termination codons, and other sequences within the open reading frame.

The term "antisense," for the purposes of the invention, refers to a nucleic acid comprising a polynucleotide that is sufficiently complementary to all or a portion of a gene, primary transcript, or processed mRNA, so as to interfere with expression of the endogenous gene. "Complementary" polynucleotides are those that are capable of base pairing according to the standard Watson-Crick complementarity rules specifically, purines will base pair with pyrimidines to form a combination of guanine paired with cytosine (G:C) and adenine paired with either thymine (A:T) in the case of DNA, or adenine paired with uracil (A:U) in the case of RNA. It is understood that two polynucleotides may hybridize to each other even if they are not completely complementary to each other, provided that each has at least one region that is substantially complementary to the other. The term "antisense nucleic acid" includes single stranded RNA as well as double-stranded DNA expression cassettes that can be transcribed to produce an antisense RNA. "Active" antisense nucleic acids are antisense RNA molecules that are capable of selectively hybridizing with a primary transcript or mRNA encoding a polypeptide having at least 80% sequence identity with the polypeptide of FIG. 1a, 1b or 1c.

The antisense nucleic acid can be complementary to an entire SRP coding strand, or to only a portion thereof. In one embodiment, an antisense nucleic acid molecule is antisense to a "coding region" of the coding strand of a nucleotide sequence encoding a SRP. The term "coding region" refers to the region of the nucleotide sequence comprising codons that are translated into amino acid residues. In another embodiment, the antisense nucleic acid molecule is antisense to a "noncoding region" of the coding strand of a nucleotide sequence encoding a SRP. The term "noncoding region" refers to 5' and 3' sequences that flank the coding region that are not translated into amino acids (i.e., also referred to as 5' and 3' untranslated regions). The antisense nucleic acid molecule can be complementary to the entire coding region of SRP mRNA, but more preferably is an oligonucleotide which is antisense to only a portion of the coding or noncoding region of SRP mRNA. For example, the antisense oligonucleotide can be complementary to the region surrounding the translation start site of PKSRP mRNA. An antisense oligonucleotide can be, for example, about 5, 10, 15, 20, 25, 30, 35, 40, 45 or 50 nucleotides in length. Typically, the antisense molecules of the present invention comprise an RNA having 60-100% sequence identity with at least 14 consecutive nucleotides of one of the nucleic acid of FIG. 1a, 1b or 1c. Preferably, the sequence identity will be at least 70%, more preferably at least 75%, 80%, 85%, 90%, 95%, 98% and most preferably 99%.

An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al., 1987, Nucleic Acids. Res. 15:6625-6641). The antisense nucleic acid molecule can also comprise a 2'-o-methylribonucleotide (Inoue et al., 1987, Nucleic Acids Res. 15:6131-6148) or a chimeric RNA-DNA analogue (Inoue et al., 1987, FEBS Lett. 215:327-330).

The antisense nucleic acid molecules of the invention are typically administered to a cell or generated in situ such that they hybridize with or bind to cellular mRNA and/or genomic DNA encoding a SRP to thereby inhibit expression of the polypeptide, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein. To achieve sufficient intracellular concentrations of the antisense molecules, vector constructs in which the antisense nucleic acid molecule is placed under the control of a strong prokaryotic, viral, or eukaryotic (including plant) promoter are preferred.

As an alternative to antisense polynucleotides, ribozymes, sense polynucleotides, or double stranded RNA (dsRNA) can be used to reduce expression of a SRP polypeptide. By "ribozyme" is meant a catalytic RNA-based enzyme with ribonuclease activity which is capable of cleaving a single-stranded nucleic acid, such as an mRNA, to which it has a complementary region. Ribozymes (e.g., hammerhead ribozymes described in Haselhoff and Gerlach, 1988, Nature 334:585-591) can be used to catalytically cleave SRP mRNA transcripts to thereby inhibit translation of SRP mRNA. A ribozyme having specificity for a SRP-encoding nucleic acid can be designed based upon the nucleotide sequence of a SRP cDNA, as disclosed herein (i.e., FIG. 1a, 1b or 1c) or on the basis of a heterologous sequence to be isolated according to methods taught in this invention. For example, a derivative of a Tetrahymena L-19 IVS RNA can be constructed in which the nucleotide sequence of the active site is complementary to the nucleotide sequence to be cleaved in a SRP-encoding mRNA. See, e.g., U.S. Pat. Nos. 4,987,071 and 5,116,742 to Cech et al. Alternatively, SRP mRNA can be used to select a catalytic RNA having a specific ribonuclease activity from a pool of RNA molecules. See, e.g., Bartel, D. and Szostak, J. W., 1993, Science 261:1411-1418. In preferred embodiments, the ribozyme will contain a portion having at least 7, 8, 9, 10, 12, 14, 16, 18 or 20 nucleotides, and more preferably 7 or 8 nucleotides, that have 100% complementarity to a portion of the target RNA. Methods for making ribozymes are known to those skilled in the art. See, e.g., U.S. Pat. Nos. 6,025,167; 5,773,260; and 5,496,698.

The term "dsRNA," as used herein, refers to RNA hybrids comprising two strands of RNA. The dsRNAs can be linear or circular in structure. In a preferred embodiment, dsRNA is specific for a polynucleotide encoding either the polypeptide of FIG. 1a, 1b or 1c or a polypeptide having at least 70% sequence identity with a polypeptide of FIG. 1a, 1b or 1c. The hybridizing RNAs may be substantially or completely complementary. By "substantially complementary," is meant that when the two hybridizing RNAs are optimally aligned using the BLAST program as described above, the hybridizing portions are at least 95% complementary. Preferably, the dsRNA will be at least 100 base pairs in length. Typically, the hybridizing RNAs will be of identical length with no over hanging 5' or 3' ends and no gaps. However, dsRNAs having 5' or 3' overhangs of up to 100 nucleotides may be used in the methods of the invention.

The dsRNA may comprise ribonucleotides or ribonucleotide analogs, such as 2'-O-methyl ribosyl residues, or combinations thereof. See, e.g., U.S. Pat. Nos. 4,130,641 and 4,024,222. A dsRNA polyriboinosinic acid:polyribocytidylic acid is described in U.S. Pat. No. 4,283,393. Methods for making and using dsRNA are known in the art. One method comprises the simultaneous transcription of two complementary DNA strands, either in vivo, or in a single in vitro reaction mixture. See, e.g., U.S. Pat. No. 5,795,715. In one embodiment, dsRNA can be introduced into a plant or plant cell directly by standard transformation procedures. Alternatively, dsRNA can be expressed in a plant cell by transcribing two complementary RNAs.

Other methods for the inhibition of endogenous gene expression, such as triple helix formation (Moser et al., 1987, Science 238:645-650 and Cooney et al., 1988, Science 241: 456-459) and cosuppression (Napoli et al., 1990, The Plant Cell 2:279-289) are known in the art. Partial and full-length cDNAs have been used for the cosuppression of endogenous plant genes. See, e.g., U.S. Pat. Nos. 4,801,340, 5,034,323, 5,231,020, and 5,283,184, Van der Kroll et al., 1990, The Plant Cell 2:291-299; Smith et al., 1990, Mol. Gen. Genetics 224:477-481 and Napoli et al., 1990, The Plant Cell 2:279-289.

For sense suppression, it is believed that introduction of a sense polynucleotide blocks transcription of the corresponding target gene. The sense polynucleotide will have at least 65% sequence identity with the target plant gene or RNA. Preferably, the percent identity is at least 80%, 90%, 95% or more. The introduced sense polynucleotide need not be full length relative to the target gene or transcript. Preferably, the sense polynucleotide will have at least 65% sequence identity with at least 100 consecutive nucleotides of one of the nucleic acids of FIG. 1a, 1b or 1c. The regions of identity can comprise introns and and/or exons and untranslated regions. The introduced sense polynucleotide may be present in the plant cell transiently, or may be stably integrated into a plant chromosome or extrachromosomal replicon.

Moreover, nucleic acid molecules encoding SRP from the same or other species such as SRP analogs, orthologs and paralogs, are intended to be within the scope of the present invention. As used herein, the term "analogs" refers to two nucleic acids that have the same or similar function, but that have evolved separately in unrelated organisms. As used herein, the term "orthologs" refers to two nucleic acids from different species that have evolved from a common ancestral gene by speciation. Normally, orthologs encode proteins having the same or similar functions. As also used herein, the term "paralogs" refers to two nucleic acids that are related by duplication within a genome. Paralogs usually have different functions, but these functions may be related (Tatusov, R. L. et al. 1997 Science 278(5338):631-637). Analogs, orthologs and paralogs of a naturally occurring stress related protein can differ from the naturally occurring stress related protein by post-translational modifications, by amino acid sequence differences, or by both. Post-translational modifications include in vivo and in vitro chemical derivatization of polypeptides e.g., acetylation, carboxylation, phosphorylation or glycosylation, and such modifications may occur during polypeptide synthesis or processing or following treatment with isolated modifying enzymes. In particular, orthologs of the invention will generally exhibit at least 80-85%, more preferably 90%, 91%, 92%, 93%, 94%, and most preferably 95%, 96%, 97%, 98% or even 99% identity or homology with all or part of a naturally occurring stress related protein amino acid sequence and will exhibit a function similar to a stress related protein. Orthologs of the present invention are also preferably capable of participating in the stress response in plants.

In addition to naturally-occurring variants of a stress related protein sequence that may exist in the population, the skilled artisan will further appreciate that changes can be introduced by mutation into a nucleotide sequence of the FIG. 1a, 1b or 1c, thereby leading to changes in the amino acid sequence of the encoded stress related protein, without altering the functional ability of the stress related protein or enhancing the functional ability of the stress related protein. For example, nucleotide substitutions leading to amino acid substitutions at "non-essential" amino acid residues to can be made in a sequence of FIG. 1. A "non-essential" amino acid residue is a residue that can be altered from the wild-type sequence of one of stress related proteins without altering the activity thereof, whereas an "essential" amino acid residue is required for stress related protein activity. Other amino acid residues, however, (e.g., those that are not conserved or only semi-conserved in the domain having SRP activity) may not be essential for activity and thus are likely to be amenable to alteration without altering SRP activity.

Accordingly, another aspect of the invention pertains to nucleic acid molecules encoding stress related proteins that contain changes in amino acid residues that are not essential for stress related protein activity. Such SRP differ in amino acid sequence from a sequence FIG. 1a, 1b or 1c, yet retain at least one of the stress related protein activities described herein. In one embodiment, the isolated nucleic acid molecule comprises a nucleotide sequence encoding a protein, wherein the protein comprises an amino acid sequence at least about 50% homologous to an amino acid sequence of FIG. 1a, 1b or 1c. Preferably, the protein encoded by the nucleic acid molecule is at least about 50-60% homologous to one of the sequences of the FIG. 1a, 1b or 1c, more preferably at least about 60-70% homologous to one of the sequences of the FIG. 1a, 1b or 1c, even more preferably at least about 70-80%, 80-90%, more preferably 90%, 91%, 92%, 93%, 94% homologous to one of the sequences of the FIG. 1a, 1b or 1c and most preferably at least about 96%, 97%, 98%, or 99% homologous to one of the sequences of the FIG. 1a, 1b or 1c. The preferred stress related protein homologs of the present invention are preferably capable of participating in the stress tolerance response in a plant. The homology (=identity) was calculated over the entire amino acid range. The program used was PileUp (J. Mol. Evolution., 25 (1987), 351-360, Higgins et al., CABIOS, 5 1989: 151-153).

Homologs of the sequences given in FIG. 1a, 1b or 1c are furthermore to be understood as meaning, for example, homologs, analogs, orthologs and paralogs which have at least 30% homology (=identity) at the derived amino acid level, preferably at least 50%, 60%, 70% or 80% homology, especially preferably at least 85% homology, very especially preferably 90% 91%, 92%, 93%, 94% homology, most preferably 95%, 96%, 97%, 98% or 99% homology. The homology (=identity) was calculated over the entire amino acid range. The program used was PileUp (J. Mol. Evolution., 25 (1987), 351-360, Higgens et al., CABIOS, 5 1989: 151-153) or the program Gap and BestFit [Needleman and Wunsch (J. Mol. Biol. 48; 443-453 (1970) and Smith and Waterman respectively (Adv. Appl. Math. 2; 482-489 (1981)] which are part of the GCG software package [Genetics Computer Group, 575 Science Drive, Madison, Wis., USA 53711 (1991)]. The above mentioned percentages of sequence homology are calculated with the program BestFit or Gap, preferably Gap, over the total sequence length with the following parameters used: Gap Weight: 8, Length Weight: 2.

Variants shall also be encompassed, in particular, functional variants which can be obtained from the sequence shown in the FIG. 1a, 1b or 1c by means of deletion, insertion or substitution of nucleotides, the enzymatic activity of the derived synthetic proteins being retained or enhanced.

An isolated nucleic acid molecule encoding a stress related protein homologous to a protein sequence of FIG. 1a, 1b or 1c can be created by introducing one or more nucleotide substitutions, additions or deletions into a nucleotide sequence of FIG. 1a, 1b or 1c such that one or more amino acid substitutions, additions or deletions are introduced into the encoded protein. Mutations can be introduced into one of the sequences of FIG. 1a, 1b or 1c by standard techniques, such as site-directed mutagenesis and PCR-mediated mutagenesis. Another route to the mutagenesis of enzymes, disclosed in the European Publication EP-A-0 909 821, is a method using the specific *Escherichia coli* strain XL1-Red to generate mutants and altered the enzyme activity.

Preferably, conservative amino acid substitutions are made at one or more predicted non-essential amino acid residues. A "conservative amino acid substitution" is one in which the amino acid residue is replaced with an amino acid residue having a similar side chain.

Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in a stress related protein is preferably replaced with another amino acid residue from the same side chain family. Alternatively, in another embodiment, mutations can be introduced randomly along all or part of a stress related protein coding sequence, such as by saturation mutagenesis, and the resultant mutants can be screened for a stress related protein activity as described herein to identify mutants that retain stress related protein activity or show enhanced stress related protein activity. Following mutagenesis of one of the sequences of the nucleic acid of FIG. 1a, 1b or 1c, the encoded protein can be expressed recombinantly and the activity of the protein can be determined by analyzing the stress tolerance of a plant expressing the protein as described in the examples below.

A useful method to ascertain the level of transcription of the gene (an indicator of the amount of mRNA available for translation to the gene product) is to perform a Northern blot (for reference see, for example, Ausubel et al., 1988 Current Protocols in Molecular Biology, Wiley: New York). This information at least partially demonstrates the degree of transcription of the gene. Total cellular RNA can be prepared from cells, tissues or organs by several methods, all well-known in the art, such as that described in Bormann, E. R. et al., 1992 Mol. Microbiol. 6:317-326. To assess the presence or relative quantity of protein translated from this mRNA, standard techniques, such as a Western blot, may be employed. These techniques are well known to one of ordinary skill in the art (see, for example, Ausubel et al., 1988 Current Protocols in Molecular Biology, Wiley: New York).

The present invention also relates to a plant expression cassette comprising a SRP coding nucleic acid selected from the group comprising sequences of the nucleic acid of FIG. 1a, 1b or 1c and/or homologs or parts thereof operatively linked to regulatory sequences and/or targeting sequences.

Further, object of the invention is an expression vector comprising a SRP encoding nucleic acid selected from the group comprising sequences of the nucleic acid of FIG. 1a, 1b or 1c and/or homologs or parts thereof or a plant expression cassette as described above, whereby expression of the SRP coding nucleic acid in a host cell results in increased tolerance to environmental stress, which is preferably achieved by altering metabolic activity, as compared to a corresponding non-transformed wild type host cell.

The invention further provides an isolated recombinant expression vector comprising a stress related protein encoding nucleic acid as described above, wherein expression of the vector or stress related protein encoding nucleic acid, respectively in a host cell results in increased tolerance and/or resistance to environmental stress, which is preferably achieved by altering metabolic activity, as compared to the corresponding non-transformed wild type of the host cell. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Further types of vectors can be linearized nucleic acid sequences, such as transposons, which are pieces of DNA which can copy and insert themselves. There have been 2 types of transposons found: simple transposons, known as Insertion Sequences and composite transposons, which can have several genes as well as the genes that are required for transposition.

Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector", can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

A plant expression cassette preferably contains regulatory sequences capable of driving gene expression in plant cells and operably linked so that each sequence can fulfill its function, for example, termination of transcription by polyadenylation signals. Preferred polyadenylation signals are those originating from *Agrobacterium tumefaciens* T-DNA such as the gene 3 known as octopine synthase of the Ti-plasmid pTiACH5 (Gielen et al., 1984 EMBO J. 3:835) or functional equivalents thereof but also all other terminators functionally active in plants are suitable.

As plant gene expression is very often not limited on transcriptional levels, a plant expression cassette preferably contains other operably linked sequences like translational enhancers such as the overdrive-sequence containing the 5'-untranslated leader sequence from tobacco mosaic virus enhancing the protein per RNA ratio (Gallie et al., 1987 Nucl. Acids Research 15:8693-8711).

Plant gene expression has to be operably linked to an appropriate promoter conferring gene expression in a timely, cell or tissue specific manner. Preferred are promoters driving constitutive expression (Benfey et al., 1989 EMBO J. 8:2195-2202) like those derived from plant viruses like the 35S CaMV (Franck et al., 1980 Cell 21:285-294), the 19S CaMV (see also U.S. Pat. No. 5,352,605 and PCT Application No. WO 8402913) or plant promoters like those from Rubisco small subunit described in U.S. Pat. No. 4,962,028.

Additional advantageous regulatory sequences are, for example, included in the plant promoters such as CaMV/35S [Franck et al., Cell 21 (1980) 285-294], PRP1 [Ward et al., Plant. Mol. Biol. 22 (1993)], SSU, OCS, lib4, usp, STLS1, B33, LEB4, nos or in the ubiquitin, napin or phaseolin promoter. Also advantageous in this connection are inducible promoters such as the promoters described in EP-A-0 388 186 (benzyl sulfonamide inducible), Plant J. 2, 1992: 397-404 (Gatz et al., Tetracyclin inducible), EP-A-0 335 528 (abscisic acid inducible) or WO 93/21334 (ethanol or cyclohexenol inducible). Additional useful plant promoters are the cytosolic FBPase promotor or ST-LSI promoter of the potato (Stockhaus et al., EMBO J. 8, 1989, 2445), the phosphorybosyl phyrophosphate amido transferase promoter of *Glycine max* (gene bank accession No. U87999) or the noden specific promoter described in EP-A-0 249 676. Additional particularly advantageous promoters are seed specific promoters which can be used for monokotyledones or dikotyledones and are described in U.S. Pat. No. 5,608,152 (napin promoter from rapeseed), WO 98/45461 (phaseolin promoter from Arobidopsis), U.S. Pat. No. 5,504,200 (phaseolin promoter from *Phaseolus vulgaris*), WO 91/13980 (Bce4 promoter from *Brassica*) and Baeumlein et al., Plant J., 2, 2, 1992: 233-239 (LEB4 promoter from leguminosa). Said promoters are useful in dikotyledones. The following promoters are useful for example in monokotyledones Ipt-2- or Ipt-1-promoter from barley (WO 95/15389 and WO 95/23230) or hordein promoter from barley. Other useful promoters are described in WO 99/16890.

It is possible in principle to use all natural promoters with their regulatory sequences like those mentioned above for the novel process. It is also possible and advantageous in addition to use synthetic promoters.

The gene construct may also comprise further genes which are to be inserted into the organisms and which are for example involved in stress resistance. It is possible and advantageous to insert and express in host organisms regulatory genes such as genes for inducers, repressors or enzymes which intervene by their enzymatic activity in the regulation, or one or more or all genes of a biosynthetic pathway. These genes can be heterologous or homologous in origin. The inserted genes may have their own promoter or else be under the control of same promoter as the sequences of the nucleic acid of FIG. 1a, 1b or 1c or their homologs.

The gene construct advantageously comprises, for expression of the other genes present, additionally 3' and/or 5' terminal regulatory sequences to enhance expression, which are selected for optimal expression depending on the selected host organism and gene or genes.

These regulatory sequences are intended to make specific expression of the genes and protein expression possible as mentioned above. This may mean, depending on the host organism, for example that the gene is expressed or overexpressed only after induction, or that it is immediately expressed and/or overexpressed.

The regulatory sequences or factors may moreover preferably have a beneficial effect on expression of the introduced genes, and thus increase it. It is possible in this way for the regulatory elements to be enhanced advantageously at the transcription level by using strong transcription signals such as promoters and/or enhancers. However, in addition, it is also possible to enhance translation by, for example, improving the stability of the mRNA.

Other preferred sequences for use in plant gene expression cassettes are targeting-sequences necessary to direct the gene product in its appropriate cell compartment (for review see Kermode, 1996 Crit. Rev. Plant Sci. 15(4):285-423 and references cited therein) such as the vacuole, the nucleus, all types of plastids like amyloplasts, chloroplasts, chromoplasts, the extracellular space, mitochondria, the endoplasmic reticulum, oil bodies, peroxisomes and other compartments of plant cells.

Plant gene expression can also be facilitated via an inducible promoter (for review see Gatz, 1997 Annu. Rev. Plant Physiol. Plant Mol. Biol. 48:89-108). Chemically inducible promoters are especially suitable if gene expression is wanted to occur in a time specific manner.

Table 1 lists several examples of promoters that may be used to regulate transcription of the stress related protein nucleic acid coding sequences.

TABLE 1

Examples of Tissue-specific and Stress inducible promoters in plants

| Expression | Reference |
|---|---|
| Cor78 - Cold, drought, salt, ABA, wounding-inducible | Ishitani, et al., Plant Cell 9: 1935-1949 (1997). Yamaguchi-Shinozaki and Shinozaki, Plant Cell 6: 251-264 (1994). |
| Rci2A - Cold, dehydration-inducible | Capel et al., Plant Physiol 115: 569-576 (1997) |
| Rd22 - Drought, salt | Yamaguchi-Shinozaki and Shinozaki, Mol Gen Genet 238: 17-25 (1993). |
| Cor15A - Cold, dehydration, ABA | Baker et al., Plant Mol. Biol. 24: 701-713 (1994). |
| GH3 - Auxin inducible | Liu et al., Plant Cell 6: 645-657 (1994) |
| ARSK1 - Root, salt inducible | Hwang and Goodman, Plant J 8: 37-43 (1995). |
| PtxA - Root, salt inducible | GenBank accession X67427 |
| SbHRGP3 - Root specific | Ahn et al., Plant Cell 8: 1477-1490 (1998). |
| KST1 - Guard cell specific | Plesch et al., Plant Journal. 28(4): 455-64, (2001) |
| KAT1 - Guard cell specific | Plesch et al., Gene 249: 83-89 (2000) Nakamura et al., Plant Physiol. 109: 371-374 (1995) |
| salicylic acid inducible | PCT Application No. WO 95/19443 |

TABLE 1-continued

Examples of Tissue-specific and Stress inducible promoters in plants

| Expression | Reference |
|---|---|
| tetracycline inducible | Gatz et al. Plant J. 2: 397-404 (1992) |
| Ethanol inducible | PCT Application No. WO 93/21334 |
| pathogen inducible PRP1 | Ward et al., 1993 Plant. Mol. Biol. 22: 361-366 |
| heat inducible hsp80 | U.S. Pat. No. 5,187,267 |
| cold inducible alpha-amylase | PCT Application No. WO 96/12814 |
| Wound-inducible pinII | European Patent No. 375091 |
| RD29A - salt-inducible | Yamaguchi-Shinozalei et al. (1993) Mol. Gen. Genet. 236: 331-340 |
| plastid-specific viral RNA-polymerase | PCT Application No. WO 95/16783 and. WO 97/06250 |

Other promoters, e.g. superpromotor (Ni et al., Plant Journal 7, 1995: 661-676), Ubiquitin promotor (Callis et al., J. Biol. Chem., 1990, 265: 12486-12493; U.S. Pat. No. 5,510, 474; U.S. Pat. No. 6,020,190; Kawalleck et al., Plant. Molecular Biology, 1993, 21: 673-684) or 34S promotor (GenBank Accession numbers M59930 and X16673) were similar useful for the present invention and are known to a person skilled in the art.

Developmental stage-preferred promoters are preferentially expressed at certain stages of development. Tissue and organ preferred promoters include those that are preferentially expressed in certain tissues or organs, such as leaves, roots, seeds, or xylem. Examples of tissue preferred and organ preferred promoters include, but are not limited to fruit-preferred, ovule-preferred, male tissue-preferred, seed-preferred, integument-preferred, tuber-preferred, stalk-preferred, pericarp-preferred, and leaf-preferred, stigma-preferred, pollen-preferred, anther-preferred, a petal-preferred, sepal-preferred, pedicel-preferred, silique-preferred, stem-preferred, root-preferred promoters, and the like. Seed preferred promoters are preferentially expressed during seed development and/or germination. For example, seed preferred promoters can be embryo-preferred, endosperm preferred, and seed coat-preferred. See Thompson et al., 1989, BioEssays 10:108. Examples of seed preferred promoters include, but are not limited to, cellulose synthase (celA), Cim1, gamma-zein, globulin-1, maize 19 kD zein (cZ19B1), and the like.

Other promoters useful in the expression cassettes of the invention include, but are not limited to, the major chlorophyll a/b binding protein promoter, histone promoters, the Ap3 promoter, the β-conglycin promoter, the napin promoter, the soybean lectin promoter, the maize 15 kD zein promoter, the 22 kD zein promoter, the 27 kD zein promoter, the g-zein promoter, the waxy, shrunken 1, shrunken 2 and bronze promoters, the Zm13 promoter (U.S. Pat. No. 5,086,169), the maize polygalacturonase promoters (PG) (U.S. Pat. Nos. 5,412,085 and 5,545,546), and the SGB6 promoter (U.S. Pat. No. 5,470,359), as well as synthetic or other natural promoters.

Additional flexibility in controlling heterologous gene expression in plants may be obtained by using DNA binding domains and response elements from heterologous sources (i.e., DNA binding domains from non-plant sources). An example of such a heterologous DNA binding domain is the LexA DNA binding domain (Brent and Ptashne, 1985, Cell 43:729-736).

The invention further provides a recombinant expression vector comprising a SRP DNA molecule of the invention cloned into the expression vector in an antisense orientation. That is, the DNA molecule is operatively linked to a regulatory sequence in a manner that allows for expression (by transcription of the DNA molecule) of an RNA molecule that is antisense to a SRP mRNA. Regulatory sequences operatively linked to a nucleic acid molecule cloned in the antisense orientation can be chosen which direct the continuous expression of the antisense RNA molecule in a variety of cell types. For instance, viral promoters and/or enhancers, or regulatory sequences can be chosen which direct constitutive, tissue specific, or cell type specific expression of antisense RNA. The antisense expression vector can be in the form of a recombinant plasmid, phagemid, or attenuated virus wherein antisense nucleic acids are produced under the control of a high efficiency regulatory region. The activity of the regulatory region can be determined by the cell type into which the vector is introduced. For a discussion of the regulation of gene expression using antisense genes, see Weintraub, H. et al., 1986, Antisense RNA as a molecular tool for genetic analysis, Reviews—Trends in Genetics, Vol. 1(1), and Mol et al., 1990, FEBS Letters 268:427-430.

Another aspect of the invention pertains to host cells into which a recombinant expression vector of the invention has been introduced. The terms "host cell" and "recombinant host cell" are used interchangeably herein. It is understood that such terms refer not only to the particular subject cell but they also apply to the progeny or potential progeny of such a cell. Because certain modifications may occur in succeeding generations due to either mutation or environmental influences, such progeny may not, in fact, be identical to the parent cell, but are still included within the scope of the term as used herein. A host cell can be any prokaryotic or eukaryotic cell. For example, a SRP can be expressed in bacterial cells such as C. glutamicum, yeast, E. coli, insect cells, fungal cells, or mammalian cells (such as Chinese hamster ovary cells (CHO) or COS cells), algae, ciliates, plant cells, fungi, or other microorganisms like C. glutamicum. Other suitable host cells are known to those skilled in the art.

A host cell of the invention, such as a prokaryotic or eukaryotic host cell in culture, can be used to produce (i.e., express) a SRP. Accordingly, the invention further provides methods for producing SRPs using the host cells of the invention. In one embodiment, the method comprises culturing the host cell of invention (into which a recombinant expression vector encoding a SRP has been introduced, or into which genome has been introduced a gene encoding a wild-type or altered SRP) in a suitable medium until SRP is produced. In another embodiment, the method further comprises isolating SRPs from the medium or the host cell.

Another aspect of the invention pertains to isolated SRPs, and biologically active portions thereof. An "isolated" or "purified" polypeptide or biologically active portion thereof is free of some of the cellular material when produced by recombinant DNA techniques, or chemical precursors or other chemicals when chemically synthesized. The language "substantially free of cellular material" includes preparations of SRP in which the polypeptide is separated from some of the cellular components of the cells in which it is naturally or recombinantly produced. In one embodiment, the language "substantially free of cellular material" includes preparations of a SRP having less than about 30% (by dry weight) of non-SRP material (also referred to herein as a "contaminating polypeptide"), more preferably less than about 20% of non-SRP material, still more preferably less than about 10% of non-SRP material, and most preferably less than about 5% non-PKSRP material.

When the SRP or biologically active portion thereof is recombinantly produced, it is also preferably substantially free of culture medium, i.e., culture medium represents less than about 20%, more preferably less than about 10%, and most preferably less than about 5% of the volume of the polypeptide preparation. The language "substantially free of chemical precursors or other chemicals" includes preparations of SRP in which the polypeptide is separated from chemical precursors or other chemicals that are involved in the synthesis of the polypeptide. In one embodiment, the language "substantially free of chemical precursors or other chemicals" includes preparations of a SRP having less than about 30% (by dry weight) of chemical precursors or non-SRP chemicals, more preferably less than about 20% chemical precursors or non-SRP chemicals, still more preferably less than about 10% chemical precursors or non-SRP chemicals, and most preferably less than about 5% chemical precursors or non-SRP chemicals. In preferred embodiments, isolated polypeptides, or biologically active portions thereof, lack contaminating polypeptides from the same organism from which the SRP is derived. Typically, such polypeptides are produced by recombinant expression of, for example, a *Saccharomyces cerevisiae, E. coli, Brassica napus, Glycine max*, or *Oryza sativa* SRP in plants other than *Saccharomyces cerevisiae, E. coli, Brassica napus, Glycine max*, or *Oryza sativa*, or microorganisms such as *C. glutamicum*, ciliates, algae or fungi.

The nucleic acid molecules, polypeptides, polypeptide homologs, fusion polypeptides, primers, vectors, and host cells described herein can be used in one or more of the following methods: identification of *Saccharomyces cerevisiae, E. coli, Brassica napus, Glycine max*, or *Oryza sativa* and related organisms; mapping of genomes of organisms related to *Saccharomyces cerevisiae, E. coli, Brassica napus, Glycine max*, or *Oryza sativa*; identification and localization of *Saccharomyces cerevisiae, E. coli, Brassica napus, Glycine max*, or *Oryza sativa* sequences of interest; evolutionary studies; determination of SRP regions required for function; modulation of a SRP activity; modulation of the metabolism of one or more cell functions; modulation of the transmembrane transport of one or more compounds; modulation of stress resistance; and modulation of expression of SRP nucleic acids.

The SRP nucleic acid molecules of the invention are also useful for evolutionary and polypeptide structural studies. The metabolic and transport processes in which the molecules of the invention participate are utilized by a wide variety of prokaryotic and eukaryotic cells; by comparing the sequences of the nucleic acid molecules of the present invention to those encoding similar enzymes from other organisms, the evolutionary relatedness of the organisms can be assessed. Similarly, such a comparison permits an assessment of which regions of the sequence are conserved and which are not, which may aid in determining those regions of the polypeptide that are essential for the functioning of the enzyme. This type of determination is of value for polypeptide engineering studies and may give an indication of what the polypeptide can tolerate in terms of mutagenesis without losing function.

Manipulation of the SRP nucleic acid molecules of the invention may result in the production of SRPs having functional differences from the wild-type SRPS. These polypeptides may be improved in efficiency or activity, may be present in greater numbers in the cell than is usual, or may be decreased in efficiency or activity.

There are a number of mechanisms by which the alteration of a SRP of the invention may directly affect stress response and/or stress tolerance. In the case of plants expressing SRPs, increased transport can lead to improved salt and/or solute partitioning within the plant tissue and organs. By either increasing the number or the activity of transporter molecules which export ionic molecules from the cell, it may be possible to affect the salt tolerance of the cell.

The effect of the genetic modification in plants, *C. glutamicum*, fungi, algae, or ciliates on stress tolerance can be assessed by growing the modified microorganism or plant under less than suitable conditions and then analyzing the growth characteristics and/or metabolism of the plant. Such analysis techniques are well known to one skilled in the art, and include dry weight, wet weight, polypeptide synthesis, carbohydrate synthesis, lipid synthesis, evapotranspiration rates, general plant and/or crop yield, flowering, reproduction, seed setting, root growth, respiration rates, photosynthesis rates, etc. (Applications of HPLC in Biochemistry in: Laboratory Techniques in Biochemistry and Molecular Biology, vol. 17; Rehm et al., 1993 Biotechnology, vol. 3, Chapter III: Product recovery and purification, page 469-714, VCH: Weinheim; Belter, P. A. et al., 1988, Bioseparations: downstream processing for biotechnology, John Wiley and Sons; Kennedy, J. F. and Cabral, J. M. S., 1992, Recovery processes for biological materials, John Wiley and Sons; Shaeiwitz, J. A. and Henry, J. D., 1988, Biochemical separations, in: Ulmann's Encyclopedia of Industrial Chemistry, vol. B3, Chapter 11, page 1-27, VCH: Weinheim; and Dechow, F. J., 1989, Separation and purification techniques in biotechnology, Noyes Publications).

For example, yeast expression vectors comprising the nucleic acids disclosed herein, or fragments thereof, can be constructed and transformed into *Saccharomyces cerevisiae* using standard protocols. The resulting transgenic cells can then be assayed for fail or alteration of their tolerance to drought, salt, and temperature stress. Similarly, plant expression vectors comprising the nucleic acids disclosed herein, or fragments thereof, can be constructed and transformed into an appropriate plant cell such as *Arabidopsis*, soy, rape, maize, wheat, *Medicago truncatula*, etc., using standard protocols. The resulting transgenic cells and/or plants derived therefrom can then be assayed for fail or alteration of their tolerance to drought, salt, temperature stress, and lodging.

The engineering of one or more SRP genes of the invention may also result in SRPs having altered activities which indirectly impact the stress response and/or stress tolerance of algae, plants, ciliates, or fungi, or other microorganisms like *C. glutamicum*. For example, the normal biochemical processes of metabolism result in the production of a variety of products (e.g., hydrogen peroxide and other reactive oxygen species) which may actively interfere with these same metabolic processes. For example, peroxynitrite is known to nitrate tyrosine side chains, thereby inactivating some enzymes having tyrosine in the active site (Groves, J. T., 1999, Curr. Opin. Chem. Biol. 3(2):226-235). While these products are typically excreted, cells can be genetically altered to transport more products than is typical for a wild-type cell. By optimizing the activity of one or more PKSRPs of the invention which are involved in the export of specific molecules, such as salt molecules, it may be possible to improve the stress tolerance of the cell.

Additionally, the sequences disclosed herein, or fragments thereof, can be used to generate knockout mutations in the genomes of various organisms, such as bacteria, mammalian cells, yeast cells, and plant cells (Girke, T., 1998, The Plant Journal 15:39-48). The resultant knockout cells can then be evaluated for their ability or capacity to tolerate various stress conditions, their response to various stress conditions, and the effect on the phenotype and/or genotype of the mutation. For other methods of gene inactivation, see U.S. Pat. No. 6,004,804 "Non-Chimeric Mutational Vectors" and Puttaraju et al., 1999, Spliceosome-mediated RNA trans-splicing as a tool for gene therapy, Nature Biotechnology 17:246-252.

The aforementioned mutagenesis strategies for SRPs resulting in increased stress resistance are not meant to be limiting; variations on these strategies will be readily apparent to one skilled in the art. Using such strategies, and incorporating the mechanisms disclosed herein, the nucleic acid and polypeptide molecules of the invention may be utilized to generate algae, ciliates, plants, fungi, or other microorganisms like C. glutamicum expressing mutated PKSRP nucleic acid and polypeptide molecules such that the stress tolerance is improved.

The present invention also provides antibodies that specifically bind to a SRP, or a portion thereof, as encoded by a nucleic acid described herein. Antibodies can be made by many well-known methods (See, e.g. Harlow and Lane, "Antibodies; A Laboratory Manual," Cold Spring Harbor Laboratory, Cold Spring Harbor, N.Y., (1988)). Briefly, purified antigen can be injected into an animal in an amount and in intervals sufficient to elicit an immune response. Antibodies can either be purified directly, or spleen cells can be obtained from the animal. The cells can then fused with an immortal cell line and screened for antibody secretion. The antibodies can be used to screen nucleic acid clone libraries for cells secreting the antigen. Those positive clones can then be sequenced. See, for example, Kelly et al., 1992, Bio/Technology 10:163-167; Bebbington et al., 1992, Bio/Technology 10:169-175.

The phrases "selectively binds" and "specifically binds" with the polypeptide refer to a binding reaction that is determinative of the presence of the polypeptide in a heterogeneous population of polypeptides and other biologics. Thus, under designated immunoassay conditions, the specified antibodies bound to a particular polypeptide do not bind in a significant amount to other polypeptides present in the sample. Selective binding of an antibody under such conditions may require an antibody that is selected for its specificity for a particular polypeptide. A variety of immunoassay formats may be used to select antibodies that selectively bind with a particular polypeptide. For example, solid-phase ELISA immunoassays are routinely used to select antibodies selectively immunoreactive with a polypeptide. See Harlow and Lane, "Antibodies, A Laboratory Manual," Cold Spring Harbor Publications, New York, (1988), for a description of immunoassay formats and conditions that could be used to determine selective binding.

In some instances, it is desirable to prepare monoclonal antibodies from various hosts. A description of techniques for preparing such monoclonal antibodies may be found in Stites et al., eds., "Basic and Clinical Immunology," (Lange Medical Publications, Los Altos, Calif., Fourth Edition) and references cited therein, and in Harlow and Lane, "Antibodies, A Laboratory Manual," Cold Spring Harbor Publications, New York, (1988):

Gene expression in plants is regulated by the interaction of protein transcription factors with specific nucleotide sequences within the regulatory region of a gene. A common type of transcription factor contains zinc finger (ZF) motifs. Each ZF module is approximately 30 amino acids long folded around a zinc ion. The DNA recognition domain of a ZF protein is a α-helical structure that inserts into the major grove of the DNA double helix. The module contains three amino acids that bind to the DNA with each amino acid contacting a single base pair in the target DNA sequence. ZF motifs are arranged in a modular repeating fashion to form a set of fingers that recognize a contiguous DNA sequence. For example, a three-fingered ZF motif will recognize 9 bp of DNA. Hundreds of proteins have been shown to contain ZF motifs with between 2 and 37 ZF modules in each protein (Isalan M, et al., 1998 Biochemistry 37(35):12026-33; Moore M, et al., 2001 Proc. Natl. Acad. Sci. USA 98(4):1432-1436 and 1437-1441; U.S. Pat. Nos. 6,007,988 and 6,013,453).

The regulatory region of a plant gene contains many short DNA sequences (cis-acting elements) that serve as recognition domains for transcription factors, including ZF proteins. Similar recognition domains in different genes allow the coordinate expression of several genes encoding enzymes in a metabolic pathway by common transcription factors. Variation in the recognition domains among members of a gene family facilitates differences in gene expression within the same gene family, for example, among tissues and stages of development and in response to environmental conditions.

Typical ZF proteins contain not only a DNA recognition domain but also a functional domain that enables the ZF protein to activate or repress transcription of a specific gene. Experimentally, an activation domain has been used to activate transcription of the target gene (U.S. Pat. No. 5,789,538 and patent application WO9519431), but it is also possible to link a transcription repressor domain to the ZF and thereby inhibit transcription (patent applications WO00/47754 and WO2001002019). It has been reported that an enzymatic function such as nucleic acid cleavage can be linked to the ZF (patent application WO00/20622)

The invention provides a method that allows one skilled in the art to isolate the regulatory region of one or more stress related protein encoding genes from the genome of a plant cell and to design zinc finger transcription factors linked to a functional domain that will interact with the regulatory region of the gene. The interaction of the zinc finger protein with the plant gene can be designed in such a manner as to alter expression of the gene and preferably thereby alter metabolic activity to confer increased (or decreased) tolerance of abiotic stress such as drought. The invention provides a method of producing a transgenic plant with a transgene encoding this designed transcription factor, or alternatively a natural transcription factor, that modifies transcription of the Stress-Related Protein, particularly stress related protein gene to provide increased tolerance of environmental stress, which is preferably achieved by altering metabolic activity. Such a regulation of plant genes by artificial polydactyl zinc fingers has been demonstrated by Ordiz et al. (Regulation of transgene Expression in plants with polydactyl zinc finger transcription factors, Ordiz et al., PNAS, 99 (20) 13290-13295, 2002) or Guan et al. (Hertiable endogenous gene regulation in plants with designed polydactyl zinc finger transcription factos, PNAS, Vol. 99 (20), 13296-13301 (2002)).

In particular, the invention provides a method of producing a transgenic plant with a stress related protein coding nucleic acid, wherein expression of the nucleic acid(s) in the plant results in increased tolerance to environmental stress, which is preferably achieved by altering metabolic activity, as compared to a wild type plant comprising: (a) transforming a plant cell with an expression vector comprising a stress related protein encoding nucleic acid, and (b) generating from the plant cell a transgenic plant with an increased tolerance to environmental stress as compared to a wild type plant. For such plant transformation, binary vectors such as pBinAR can be used (Höfgen and Willmitzer, 1990 Plant Science 66:221-230). Moreover suitable binary vectors are for example pBIN19, pBI101, pGPTV or pPZP (Hajukiewicz, P. et al., 1994, Plant Mol. Biol., 25: 989-994).

Construction of the binary vectors can be performed by ligation of the cDNA into the T-DNA. 5' to the cDNA a plant promoter activates transcription of the cDNA. A polyadenylation sequence is located 3' to the cDNA. Tissue-specific expression can be achieved by using a tissue specific promoter as listed above. Also, any other promoter element can be used. For constitutive expression within the whole plant, the CaMV 35S promoter can be used. The expressed protein can be targeted to a cellular compartment using a signal peptide, for example for plastids, mitochondria or endoplasmic reticulum (Kermode, 1996 Crit. Rev. Plant Sci. 4(15): 285-423). The signal peptide is cloned 5' in frame to the cDNA to archive subcellular localization of the fusion protein. Additionally, promoters that are responsive to abiotic stresses can be used with, such as the *Arabidopsis* promoter RD29A. One skilled in the art will recognize that the promoter used should be operatively linked to the nucleic acid such that the promoter causes transcription of the nucleic acid which results in the synthesis of a mRNA which encodes a polypeptide.

Alternate methods of transfection include the direct transfer of DNA into developing flowers via electroporation or *Agrobacterium* mediated gene transfer. *Agrobacterium* mediated plant transformation can be performed using for example the GV3101 (pMP90) (Koncz and Schell, 1986 Mol. Gen. Genet. 204:383-396) or LBA4404 (Ooms et al., Plasmid, 1982, 7: 15-29; Hoekema et al., Nature, 1983, 303: 179-180) *Agrobacterium tumefaciens* strain. Transformation can be performed by standard transformation and regeneration techniques (Deblaere et al., 1994 Nucl. Acids. Res. 13:4777-4788; Gelvin and Schilperoort, Plant Molecular Biology Manual, 2nd Ed.—Dordrecht: Kluwer Academic Publ., 1995.—in Sect., Ringbuc Zentrale Signatur: BT11-P ISBN 0-7923-2731-4; Glick, B R and Thompson, J E, Methods in Plant Molecular Biology and Biotechnology, Boca Raton: CRC Press, 1993-360 S., ISBN 0-8493-5164-2). For example, rapeseed can be transformed via cotyledon or hypocotyl transformation (Moloney et al., 1989 Plant Cell Reports 8:238-242; De Block et al., 1989 Plant Physiol. 91:694-701). Use of antibiotics for *Agrobacterium* and plant selection depends on the binary vector and the *Agrobacterium* strain used for transformation. Rapeseed selection is normally performed using kanamycin as selectable plant marker. *Agrobacterium* mediated gene transfer to flax can be performed using, for example, a technique described by Mlynarova et al., 1994 Plant Cell Report 13:282-285. Additionally, transformation of soybean can be performed using for example a technique described in European Patent No. 0424 047, U.S., Pat. No. 5,322,783, European Patent No. 0397 687, U.S. Pat. Nos. 5,376,543 or 5,169,770. Transformation of maize can be achieved by particle bombardment, polyethylene glycol mediated DNA uptake or via the silicon carbide fiber technique (see, for example, Freeling and Walbot "The maize handbook" Springer Verlag: New York (1993) ISBN 3-540-97826-7). A specific example of maize transformation is found in U.S. Pat. No. 5,990,387 and a specific example of wheat transformation can be found in PCT Application No. WO 93/07256.

The stress related protein encoding nucleic acid molecules of the invention have a variety of uses. Most importantly, the nucleic acid and amino acid sequences of the present invention can be used to transform plant cells or plants, thereby inducing tolerance to stresses such as drought, high salinity and cold. The present invention therefore provides a transgenic plant transformed by a stress related protein encoding nucleic acid (coding or antisense), wherein expression of the nucleic acid sequence in the plant results in increased tolerance to environmental stress as compared to a wild type plant. The increased stress tolerance is apparent as an increase in the yield or quality of the plant. The transgenic plant can be a monocot or a dicot or a gymnosperm plant. The invention further provides that the transgenic plant can be selected from maize, wheat, rye, oat, triticale, rice, barley, soybean, peanut, cotton, borage, safflower, linseed, primrose, rapeseed, canola and turnip rape, *manihot*, pepper, sunflower, tagetes, solanaceous plant such as potato, tobacco, eggplant and tomato, *Vicia* species, pea, alfalfa, bushy plants such as coffee, cacao, tea, *Salix* species, trees such as oil palm, coconut, perennial grass, such as ryegrass and fescue, and forage crops, such as alfalfa and clover and *Arabidopsis thaliana*. Further the transgenic plant can be selected from spruce, pine or fir for example.

In particular, the present invention describes using the expression of stress related proteins to engineer drought-tolerant, salt-tolerant and/or cold-tolerant plants. This strategy has herein been demonstrated for *Arabidopsis thaliana*, Ryegrass, Alfalfa, Rapeseed/Canola, Soybean, Corn and Wheat but its application is not restricted to these plants. Accordingly, the invention provides a transgenic plant containing a stress related protein encoding gene selected from the nucleic acid of FIG. 1*a*, 1*b* or 1*c* and/or homologs of the afore mentioned sequences, wherein the environmental stress is drought, increased salt or decreased or increased temperature but its application is not restricted to these adverse environments. Protection against other adverse conditions such as heat, air pollution, heavy metals and chemical toxicants, for example, may be obtained. In preferred embodiments, the environmental stress is drought.

The present invention also provides methods of modifying stress tolerance of a plant comprising, modifying the expression of a stress related protein encoding gene in the plant. The invention provides that this method can be performed such that the stress tolerance is increased. This can for example be done by the use of transcription factors. In particular, the present invention provides methods of producing a transgenic plant having an increased tolerance to environmental stress as compared to a wild type plant due to increased expression of a stress related protein in the plant.

Growing the modified plants under stress conditions and then screening and analyzing the growth characteristics and/or metabolic activity assess the effect of the genetic modification in plants on stress tolerance and/or resistance. Such analysis techniques are well known to one skilled in the art. They include next to screening (Römpp Lexikon Biotechnologie, Stuttgart/New York: Georg Thieme Verlag 1992, "screening" p. 701) dry weight, wet weight, protein synthesis, carbohydrate synthesis, lipid synthesis, evapotranspiration rates, general plant and/or crop yield, flowering, reproduction, seed setting, root growth, respiration rates, photosynthesis rates, etc. (Applications of HPLC in Biochemistry in: Laboratory Techniques in Biochemistry and Molecular Biology, vol. 17; Rehm et al., 1993 Biotechnology, vol. 3, Chapter III: Product recovery and purification, page 469-714, VCH: Weinheim; Belter, P. A. et al., 1988 Bioseparations: downstream processing for biotechnology, John Wiley and Sons; Kennedy, J. F. and Cabral, J. M. S., 1992 Recovery processes for biological materials, John Wiley and Sons; Shaeiwitz, J. A. and Henry, J. D., 1988 Biochemical separations, in: Ulmann's Encyclopedia of Industrial Chemistry, vol. B3, Chapter 11, page 1-27, VCH: Weinheim; and Dechow, F. J. (1989) Separation and purification techniques in biotechnology, Noyes Publications).

The engineering of one or more stress related protein encoding genes of the invention may also result in stress related proteins having altered activities which indirectly impact the stress response and/or stress tolerance of plants. For example, the normal biochemical processes of metabolism result in the production of a variety of products (e.g., hydrogen peroxide and other reactive oxygen species) which may actively interfere with these same metabolic processes (for example, peroxynitrite is known to react with tyrosine side chains, thereby inactivating some enzymes having tyrosine in the active site (Groves, J. T., 1999 Curr. Opin. Chem. Biol. 3(2):226-235). By optimizing the activity of one or more stress related proteins (enzymes) of the invention, it may be possible to improve the stress tolerance of the cell.

Throughout this application, various publications are referenced. The disclosures of all of these publications and those references cited within those publications in their entireties are hereby incorporated by reference into this application in order to more fully describe the state of the art to which this invention pertains.

It should also be understood that the foregoing relates to preferred embodiments of the present invention and that numerous changes and variations may be made therein without departing from the scope of the invention. The invention is further illustrated by the following examples, which are not to be construed in any way as limiting. On the contrary, it is to be clearly understood that various other embodiments, modifications and equivalents thereof, which, after reading the description herein, may suggest themselves to those skilled in the art without departing from the spirit of the present invention and/or the scope of the claims.

The invention also pertains to the use of SRP encoding nucleic acid selected form the group comprising the nucleic acid of FIG. 1a, 1b or 1c and/or homologs of the afore mentioned sequences for preparing a plant cell with increased environmental stress tolerance, which is preferably achieved by altering metabolic activity. The said sequences can also be used for preparing a plant with increased environmental stress tolerance.

Object of the invention is further the use of altered metabolic activity and/or a SRP encoding nucleic acid selected form the group of sequences of the nucleic acid of FIG. 1a, 1b or 1c and/or homologs of the afore mentioned sequences or parts thereof as markers for selection of plants with increased tolerance to environmental stress or as markers for detection of stress in plants or plant cells.

EXAMPLE 1

Engineering Stress-Tolerant *Arabidopsis* Plants by Over-Expressing Stress Related Protein Genes Gene Cloning and Transformation of *Arabidopsis thaliana*

Amplification

The standard protocol of Pfu DNA polymerase or a Pfu/Taq DNA polymerase mix (Herculase) was used for the amplification procedure. Amplified ORF fragments were analysed by gel electrophoresis. Each primer consists of a universal 5 end and ORF specific 3' end whereby the universal sequences differ for the forward and reverse primers (forward primer sequence contains an EcoRI for yeast or SmaI for *E. coli* and the reverse primer sequence a SmaI for yeast or SacI for *E. coli* restriction site) allowing generally a unidirectional cloning success.

Amplification using the protocol of Pfu or Herculase DNA polymerase (Stratagene). Conditions: 1×PCR buffer, 0.2 mM dNTP, 100 ng genomic DNA *Saccharomyces cerevisiae* (S288C) or 60 ng genomic DNA *Escherichia coli* K-12 (MG1655), 25 pmol forward primer, 25 pmol reverse primer, 2.5 u Pfu or Herculase DNA polymerase. 1st cycle for 3' for yeast of 2' for *E. coli* at 94° C., followed by 25 cycles for 30" at 94° C., 30" 55° C. for yeast or 60° C. for *E. coli* and 5-6' 72° C., followed by 1 cycle for 610' at 72° C., final for 4° C. at ∞.

Table 2: Forward and reverse primer sequences used for ORF amplification

TABLE 2

Forward and reverse primer sequences used for ORF amplification

| Gene | Forward Seq |
|---|---|
| YGL263W | GGAATTCCAGCTGACCACCATGGATGGAGCCAAATTTGAAAATAC (SEQ ID NO: 561) |
| YGR004W | GGAATTCCAGCTGACCACCATGAGCGAAATAAATAATGAAAATCTAG (SEQ ID NO: 562) |
| YGR014W | GGAATTCCAGCTGACCACCATGCAGTTTCCATTCGCTTGTCTC (SEQ ID NO: 563) |
| YGL239C | GGAATTCCAGCTGACCACCATGAAATTTTTTGAAGAACAAAGCACC (SEQ ID NO: 564) |
| YBL060W | GGAATTCCAGCTGACCACCATGTGCGCCAGTTTAAACGAGGTA (SEQ ID NO: 565) |
| YGL166W | GGAATTCCAGCTGACCACCATGGTCGTAATTAACGGGGTCAAAT (SEQ ID NO: 566) |
| YDL202W | GGAATTCCAGCTGACCACCATGTTGCAGCTAAGGTTTATGCCT (SEQ ID NO: 567) |
| YAL046C | GGAATTCCAGCTGACCACCATGAAGCTCCCACAGACCATGCT (SEQ ID NO: 568) |
| YDR101C | GGAATTCCAGCTGACCACCATGGCTCTAGCTATCTCCCACGA (SEQ ID NO: 569) |
| YDR108W | GGAATTCCAGCTGACCACCATGGTTTTTTCTTATGAGCACTATATG (SEQ ID NO: 570) |
| YAL064W | GGAATTCCAGCTGACCACCATGCGATATACTGCAACTTTTCGG (SEQ ID NO: 571) |
| VDR134C | GGAATTCCAGCTGACCACCATGCAATTCTCTACCGTCGCTTCT (SEQ ID NO: 572) |
| YFL031w | GGAATTCCAGCTGACCACCATGAATAGCGAGTACGATTACCTGT (SEQ ID NO: 573) |
| YFL052W | GGAATTCCAGCTGACCACCATGGCCCGCAATAGACAAGCGT (SEQ ID NO: 574) |

TABLE 2-continued

Forward and reverse primer sequences used for ORF amplification

| Gene | Forward Seq |
|---|---|
| YFL042C | GGAATTCCAGCTGACCACCATGTCGGATGTAGATAACTGGGAA (SEQ ID NO: 575) |
| YBR025C | GGAATTCCAGCTGACCACCATGCCTCCAAAGAAGCAAGTCGAA (SEQ ID NO: 576) |
| YER174C | GGAATTCCAGCTGACCACCATGACTGTGGTTGAAATAAAAAGCC (SEQ ID NO: 577) |
| YBR051W | GGAATTCCAGCTGACCACCATGCACATTCTTTTCTTGTTTATTTTC (SEQ ID NO: 578) |
| YER175C | GGAATTCCAGCTGACCACCATGTCTACCTTTTCTGCTTCTGATT (SEQ ID NO: 579) |
| YDR521W | GGAATTCCAGCTGACCACCATGAAAGGTTCAAAATCGCACCTTG (SEQ ID NO: 580) |
| YER167W | GGAATTCCAGCTGACCACCATGCCGAAGAATAGTCACCACCAT (SEQ ID NO: 581) |
| YER123W | GGAATTCCAGCTGACCACCATGTCCCAACGATCTTCACAACAC (SEQ ID NO: 582) |
| YDR415C | GGAATTCCAGCTGACCACCATGGCCGATGAGGAACGTTTAAAG (SEQ ID NO: 583) |
| YEL052W | GGAATTCCAGCTGACCACCATGATCGCTTTGAAGCCCAATGCT (SEQ ID NO: 584) |
| YDR536W | GGAATTCCAGCTGACCACCATGAAGGATTTAAAATTATCGAATTTCA (SEQ ID NO: 585) |
| YDR513W | GGAATTCCAGCTGACCACCATGGAGACCAATTTTTCCTTCGACT (SEQ ID NO: 586) |
| YEL045C | GGAATTCCAGCTGACCACCATGAAATGTCACGCGAAACGGAC (SEQ ID NO: 587) |
| YEL041W | GGAATTCCAGCTGACCACCATGAAAACTGATAGATTACTGATTAAC (SEQ ID NO: 588) |
| YDL238C | GGAAATTCCAGCTGACCACCATGACAAAAAGTGATTTATTATTTTGATAA (SEQ ID NO: 589) |
| YBR282W | GGAATTCCAGCTGACCACCATAAAGGCTCACCCATTTCTCAAT (SEQ ID NO: 590) |
| YBR258C | GGAATTCCAGCTGACCACCATGGCGTATAATCAAGAAGATAGTAA (SEQ ID NO: 591) |
| YCL001W-A | GGAATTCCAGCTGACCACCATGACCTTTTTACAATTTATCAATAATAATA (SEQ ID NO: 592) |
| YBR274W | GGAATTCCAGCTGACCACCATGAGTCTCTCGCAGGTGTCAC (SEQ ID NO: 593) |
| YHR090C | GGAATTCCAGCTGACCACCATGGATCCAAGTTTAGTTTAGAGC (SEQ ID NO: 594) |
| YGR121C | GGAATTCCAGCTTGACCACCATGGAGAGTCGAACTACAGGGC (SEQ ID NO: 595) |
| YGR127W | GGAATTCCAGCTGACCACCATGTGCATTTTAATGGCCACAAGG (SEQ ID NO: 596) |
| YGR150C | GGAATTCCAGCTGACCACCATGTACATGGCCAGATGTGGCC (SEQ ID NO: 597) |
| YKL037W | GGAATTTCCAGCTGACCACCATGCAGACAATGGGCGGGGAG (SEQ ID NO: 598) |
| YKL051W | GGAATTCCAGCTGACCACCATGAATTCAATTTAAAAGTCCAGGTAAC (SEQ ID NO: 599) |
| YKL120W | GGAATTCCAGCTGACCACCATGTCATCTGACAACTCTAAACAAG (SEQ ID NO: 600) |
| YKL011C | GGAATTCCAGCTGACCACCATGTCGACAGCACAGAAAGCTAAG (SEQ ID NO: 601) |
| YKL017C | GGAATTCCAGCTGACCACCATGAACAAAGAATTGGCTTCTAAGTT (SEQ ID NO: 602) |
| YKL049C | GGAATTCCAGCTGACCACCATGGAAACTGAAGTACCTGCACCA (SEQ ID NO: 603) |
| YKL132C | GGAATTCCAGCTGACCACCATGGATGATATAAGCGGAAGGCAAA (SEQ ID NO: 604) |
| YGR126W | GGAATTCCAGCTGACCACCATGCCTGTCCCATCTGTTACTGT (SEQ ID NO: 605) |
| YKL070W | GGAATTCCAGCTGACCACCATGTACATTCCTAAACATTTTGAGTC (SEQ ID NO: 606) |
| YKL058W | GGAATTCCAGCTGACCACCATGGCAGTACCCGGGTATTACGA (SEQ ID NO: 607) |
| YHR130C | GGAATTCCAGCTGACCACCATGACTAAAAGTATATATATTATCATCG (SEQ ID NO: 608) |
| YIL070C | GGAATTCCAGCTGACCACCATGTTCTTAAGAAGCGTTAACCGTG (SEQ ID NO: 609) |
| YHR195W | GGAATTCCAGCTGACCACCATGACTCGTCCCCCATTGGTTC (SEQ ID NO: 610) |
| YHR022W | GGAATTCCAGCTGACCACCATGAATCTAAGATTTGAATTGCAGAAA (SEQ ID NO: 611) |
| YJL089W | GGAATTCCAGCTGACCACCATGGCCAAGAGGAAATATGGCAG (SEQ ID NO: 612) |

TABLE 2-continued

Forward and reverse primer sequences used for ORF amplification

| Gene | Forward Seq |
|---|---|
| YJL172W | GGAATTCCAGCTGACCACCATGATCGCCTTACCAGTAGAGAAG (SEQ ID NO: 613) |
| YHR113W | GGAATTCCAGCTGACCACCATGTTCAGGATACAACTGAGAACTA (SEQ ID NO: 614) |
| YHR175W | GGAATTCCAGCTGACCACCATGGATGATAAGAAAACATGGAGTAC (SEQ ID NO: 615) |
| YGR212W | GGAATTCCAGCTGACCACCATGAATCTTAAACTTTCTGCTATTGAA (SEQ ID NO: 616) |
| YJL024C | GGAATTCCAGCTGACCACCATGATTCATGCAGTTCTAATATGTATG (SEQ ID NO: 617) |
| YGR180c | GGAATTCCAGCTGACCACCATGGAAGCACATAACCAATTTTTGAA (SEQ ID NO: 618) |
| YJL179W | GGAATTCCAGCTGACCACCATGTCACAGATAGCACAAGAAATGA (SEQ ID NO: 619) |
| YJL001W | GGAATTCCAGCTGACCACCATGAATGGAATTCAAGTGGACATCA (SEQ ID NO: 620) |
| YJL208C | GGAATTCCAGCTGACCACCATGTGCAGTAGGATACTCTTGTCC (SEQ ID NO: 621) |
| YJL152W | GGAATTCCAGCTGACCACCATGCCGCATTTAGCCGCCGAAG (SEQ ID NO: 622) |
| YJL131C | GGAATTCCAGCTGACCACCATGTTAAAAGTTCCTTTGAGTGATGT (SEQ ID NO: 623) |
| YJL151C | GGAATTCCAGCTGACCACCATGGACAGAGACCATATTAATGACC (SEQ ID NO: 624) |
| YLR441C | GGAATTCCAGCTGACCACCATGGCTGTCGGAAAGAATAAGAGA (SEQ ID NO: 625) |
| YLR415C | GGAATTCCAGCTGACCACCATGTATCTCAGTGCCCAGCTTATG (SEQ ID NO: 626) |
| YLR212C | GGAATTCCAGCTGACCACCATGGGTGGAGAAATTATTACTTTGC (SEQ ID NO: 627) |
| YLR029C | GGAATTCCAGCTGACCACCATGGGTGCCTACAAATATTTGGAAAG (SEQ ID NO: 628) |
| YLL041C | GGAATTCCAGCTGACCACCATGTTGAACGTGCTATTGAGAAGGA (SEQ ID NO: 629) |
| YLR105C | GGAATTCCAGCTGACCACCATGTCTAAAGGGAGGGTCAATCAG (SEQ ID NO: 630) |
| YIL136W | GGAATTCCAGCTGACCACCATGTCATCAAGAATAATTGTCGGCA (SEQ ID NO: 631) |
| YLR215C | GGAATTCCAGCTGACCACCATGTCCTCACAAGAATATACAACTTT (SEQ ID NO: 632) |
| YLR321C | GGAATTCCAGCTGACCACCATGTCGCACCAAAACCAGCTTATT (SEQ ID NO: 633) |
| YMR260C | GGAATTCCAGCTGACCACCATGGGTAAGAAAAACACTAAAGGTG (SEQ ID NO: 634) |
| YNL120C | GGAATTCCAGCTGACCACCATGATAAAAGTCGATACTTCCGATG (SEQ ID NO: 635) |
| YLR407W | GGAATTCCAGCTGACCACCATGACTGTTTCTACTTCCAAGACC (SEQ ID NO: 636) |
| YMR197C | GGAATTCCAGCTGACCACCATGAGTTCCCTATTAATATCATACGA (SEQ ID NO: 637) |
| YMR100W | GGAATTCCAGCTGACCACCATGAGAGACTCTAATCATCGATCAT (SEQ ID NO: 638) |
| YMR210W | GGAATTCCAGCTGACCACCATGCGTCTAAAAGAATTGTTACCTAA (SEQ ID NO: 639) |
| YMR318C | GGAATTCCAGCTGACCACCATGTCTTATCCTGAGAAATTTGAAGG (SEQ ID NO: 640) |
| YMR069W | GGAATTCCAGCTGACCACCATGCGTTCTTCGGTATATAGTGAGA (SEQ ID NO: 641) |
| YNL076W | GGAATTCCAGCTGACCACCATGTCGCGGGAGGCATTTGATGT (SEQ ID NO: 642) |
| YNL024C | GGAATTCCAGCTGACCACCATGGAGAGTATATTTGGTGGGTTTG (SEQ ID NO: 643) |
| YNL125C | GGAATTCCAGCTGACCACCATGTCAACGCACTCAAACGACTAC (SEQ ID NO: 644) |
| YNL029C | GGAATTCCAGCTGACCACCATGTTGCTAATAAGAAGGACGATAAA (SEQ ID NO: 645) |
| YMR115W | GGAATTCCAGCTGACCACCATGCTTTTACAAGGAATGCGTTTATC (SEQ ID NO: 646) |
| YNL244C | GGAATTCCAGCTGACCACCATGTCCATTGAGAATCTGAAATCATT (SEQ ID NO: 647) |
| YNL334C | GGAATTCCAGCTGACCACCATGACCGTCGTTATCGGAGTCTT (SEQ ID NO: 648) |
| YNR018W | GGAATTCCAGCTGACCACCATGAAGATTTTAACCCAAGACGAAAT (SEQ ID NO: 649) |

TABLE 2-continued

Forward and reverse primer sequences used for ORF amplification

| Gene | Forward Seq |
|---|---|
| YNL277W | GGAATTCCAGCTGACCACCATGTCGCATACTTTAAAATCGAAAAC (SEQ ID NO: 650) |
| YOL118C | GGAATTCCAGCTGACCACCATGTCTTTTAGAAAGAAAAAACTCAAAC (SEQ ID NO: 651) |
| YOL123W | GGAATTCCAGCTGACCACCATGAGCTCTGACGAAGAAGATTTCA (SEQ ID NO: 652) |
| YOR020C | GGAATTCCAGCTGACCACCATGTCCACCCTTTTGAAGTCTGCT (SEQ ID NO: 653) |
| YOL116W | GGAATTCCAGCTGACCACCATGGCAAGTAACCAGCACATAGGA (SEQ ID NO: 654) |
| YOR305w | GGAATTCCAGCTGACCACCATGATAAAAAACTATTTGGGACGAAG (SEQ ID NO: 655) |
| YPL267W | GGAATTCCAGCTGACCACCATGATATCACCATCAAAAAAGAGAAC (SEQ ID NO: 656) |
| YPL229w | GGAATTCCAGCTGACCACCATGATGCCCTACAACACCCCTC (SEQ ID NO: 657) |
| YPL038W | GGAATTCCAGCTGACCACCATGAAACTGGCGCAAGACATGAAT (SEQ ID NO: 658) |
| YPR047W | GGAATTCCAGCTGACCACCATGGAGGTAACTTCAATGTTTCTCA (SEQ ID NO: 659) |
| YPL011C | GGAATTCCAGCTGACCACCATGACTACAAATAATGACTTCTATTTTG (SEQ ID NO: 660) |
| YPR148C | GGAATTCCAGCTGACCACCATGTCTGGTTATTTTTCAGGGTTTTC (SEQ ID NO: 661) |
| YOL103W | GGAATTCCAGCTGACCACCATGGCTGAAATGAAGAATTCGACAG (SEQ ID NO: 662) |
| YOR016C | GGAATTCCAGCTGACCACCATGCGCGTTTTTACTTTGATTGCGA (SEQ ID NO: 663) |
| YPL079W | GGAATTCCAGCTGACCACCATGGGTAAATCGTATGTCCATATAAC (SEQ ID NO: 664) |
| YOR260W | GGAATTCCAGCTGACCACCATGTCAATTCAGGCTTTTGTCTTTTG (SEQ ID NO: 665) |
| YOR360C | GGAATTCCAGCTGACCACCATGTCCACCCTTTTTCTGATTGGAA (SEQ ID NO: 666) |
| YDL060W | GGAATTCCAGCTGACCACCATGGCAGGTCATTCACACAGGTC (SEQ ID NO: 667) |
| YDL005C | GGAATTCCAGCTGACCACCATGGTAGTACAAAATAGCCCAGTTT (SEQ ID NO: 668) |
| YPL210C | GGAATTCCAGCTGACCACCATGAAAGAAAGCAAAAAATGGCTAAA (SEQ ID NO: 669) |
| YMR118C | GGAATTCCAGCTGACCACCATGAAAGCAACCATTCAAAGAGTAAC (SEQ ID NO: 670) |
| YPR052C | GGAATTCCAGCTGACCACCATGGTCACCCCAAGAGAACCTAA (SEQ ID NO: 671) |
| YLR224W | GGAATTCCAGCTGACCACCATGAATCAGAGCGATAGCAGCTTG (SEQ ID NO: 672) |
| YLR275W | GGAATTCCAGCTGACCACCATGTCGTATGTTTGATCTTAACCATT (SEQ ID NO: 673) |
| YMR154C | GGAATTCCAGCTGACCACCATGAATGATTGGCATGAGTTCAATG (SEQ ID NO: 674) |
| YDR205w | GGAATTCCAGCTGACCACCATGGATAGAGGCAGGTGGTGTTT (SEQ ID NO: 675) |
| YPR037C | GGAATTCCAGCTGACCACCATGAAACAGATAGTCAAAAGAAGCC (SEQ ID NO: 676) |
| YNR008W | GGAATTCCAGCTGACCACCATGGGCACACTGTTTCGAAGAAAT (SEQ ID NO: 677) |
| YOR084W | GGAATTCCAGCTGACCACCATGGAACAGAACAGGTTCAAGAAAG (SEQ ID NO: 678) |
| YGR054W | GGAATTCCAGCTGACCACCATGTCATCTCAGTTTTTCCTGAAAAC (SEQ ID NO: 679) |
| YGL106W | GGAATTCCAGCTGACCACCATGTCAGCCACCAGAGCCAATAAA (SEQ ID NO: 680) |
| YAL067C | GGAATTCCAGCTGACCACCATGTATTCAATTGTTAAAGAGATTATTG (SEQ ID NO: 681) |
| YIL023c | GGAATTCCAGCTGACCACCATGAAGGCGTCGCACATTTGCTC (SEQ ID NO: 682) |
| YBR064W | GGAATTCCAGCTGACCACCATGGATATGGTATCACCAGTCTTGA (SEQ ID NO: 683) |
| b0019 | TTGCTCTTCCATGAAACATCTGCATCGATTCTTTAG (SEQ ID NO: 684) |
| b2148 | TTGCTCTTCCATGAGTGCGTTAAATAAGAAAAG (SEQ ID NO: 685) |
| b2796 | TTGCTCTTCCATGGAAACGACTCAAACCAGCAC (SEQ ID NO: 686) |
| b2082 | TTGCTCTTCCATGTTTCATTTGTCCTTTATGCCAGC (SEQ ID NO: 687) |

TABLE 2-continued

Forward and reverse primer sequences used for ORF amplification

| Gene | Forward Seq |
|---|---|
| b0124 | TTGCTCTTCCATGGCAATTAACAATACAGGCTCG (SEQ ID NO: 688) |
| b3116 | TTGCTCTTCCATGAGTACTTCAGATAGCATTGTATC (SEQ ID NO: 689) |
| b1830 | TTGCTCTTCCATGAACATGTTTTTTAGGCTTACC (SEQ ID NO: 690) |
| b1453 | TTGCTCTTCCATGTTCATGGCAACTTATATGACTTTT (SEQ ID NO: 691) |
| b2664 | TTGCTCTTCCATGATCAGGAGTCACACCATGA (SEQ ID NO: 692) |
| b2799 | TTGCTCTTCCATGATGGCTAACAGAATGATTCTGA (SEQ ID NO: 693) |
| b3327 | TTGCTCTTCCATGAATTATCGCTATCGCGCCA (SEQ ID NO: 694) |
| b0970 | TTGCTCTTCCATGGATCGTATTGTTAGTTCTTCAC (SEQ ID NO: 695) |
| YER003C | GGAATTCCAGCTGACCACCATGTCCAACAAGCTGTTCAGGTTA (SEQ ID NO: 696) |
| YCL027W | GGAATTCCAGCTGACCACCATGGTAGCAACAATAATGCAGACGA (SEQ ID NO: 697) |
| YBR112C | GGAATTCCAGCTGACCACCATGAATCCGGGCGGTGAACAAAC (SEQ ID NO: 698) |
| YNL079C | GGAATTCCAGCTGACCACCATGGACAAAATCAGAGAAAAGCTAAG (SEQ ID NO: 699) |
| YFR042W | GGAATTCCAGCTGACCACCATGGCAGGTATCAAGTTGACGCAT (SEQ ID NO: 700) |
| YER137C | GGAATTCCAGCTGACCACCATGTGTGAATCATCAAATAAGACTGA (SEQ ID NO: 701) |
| YKL103C | GGAATTCCAGCTGACCACCATGGAGGAACAACGTGAAATACTG (SEQ ID NO: 702) |
| YNL090W | GGAATTCCAGCTGACCACCATGTCTGAAAAGGCCGTTAGAAGG (SEQ ID NO: 703) |
| YGR161C | GGAATTCCAGCTGACCACCATGATCGCTACCTCCAGAGCCG (SEQ ID NO: 704) |
| YDR071C | GGAATTCCAGCTGACCACCATGGCCTCCTCAAGTAGCACGC (SEQ ID NO: 705) |

| Gene | Reverse Seq |
|---|---|
| YGL263W | GATCCCCGGGAATTGCCATGTTACACATCATTGCAAGCTGATTGT (SEQ ID NO: 706) |
| YGR004W | GATCCCCGGGAATTGCCATGTTATAGAGAAGGAGACATTGAAACAT (SEQ ID NO: 707) |
| YGR014W | GATCCCCGGGAATTGCCATGTCAAACTTCGTTCCAACCCAGGG (SEQ ID NO: 708) |
| YGL239C | GATCCCCGGGAATTGCCATGTCAATTGCAGGGATTATGGAATAAAA (SEQ ID NO: 709) |
| YBL060W | GATCCCCGGGAATTGCCATGTAGAACTGAACAGAACCCATGGC (SEQ ID NO: 710) |
| YGL166W | GATCCCCGGGAATTGCCATGTTATTGTGAATGTGAGTTATGCGAAG (SEQ ID NO: 711) |
| YDL202W | GATCCCCGGGAATTGCCATGTACTTTGATCCCTTCGATTCTGCA (SEQ ID NO: 712) |
| YAL046C | GATCCCCGGGAATTGCCATGTCATGATGATGCCGGACCCTTC (SEQ ID NO: 713) |
| YDR101C | GATCCCCGGGAATTGCCATGCTACATTTTCATGGTTTCTTCAACTC (SEQ ID NO: 714) |
| YDR108W | GATCCCCGGGAATTGCCATGTCATCCAATAAAGCTAACACTTGTTC (SEQ ID NO: 715) |
| YAL064W | GATCCCCGGGAATTGCCATGCTATGGTTCGCTATTCAATATTAGAA (SEQ ID NO: 716) |
| YDR134C | GATCCCCGGGAATTGCCATGTTACAACAATAAAGCGGCAGCACC (SEQ ID NO: 717) |
| YFL031w | GATCCCCGGGAATTGCCATGTCAACAGCAGCCCCCACCGGT (SEQ ID NO: 718) |
| YFL052W | GATCCCCGGGAATTGCCATGTTAAGGAAGCGCATCTACATCTTCT (SEQ ID NO: 719) |
| YFL042C | GATCCCCGGGAATTGCCATGTCAACCATACCTTTGATCCAACTG (SEQ ID NO: 720) |
| YBR025C | GATCCCCGGGAATTGCCATGTCAATTCTTACCAGCACCAGCTCT (SEQ ID NO: 721) |

-continued

| Gene | Reverse Seq |
|---|---|
| YER174C | GATCCCCGGGAATTGCCATGTTACTGTAGAGCATGTTGGAAATATT (SEQ ID NO: 722) |
| YBR051W | GATCCCCGGGAATTGCCATGTTATATATGGCATGTCTTCGCATGT (SEQ ID NO: 723) |
| YER175C | GATCCCCGGGAATTGCCATGTCAGACCCTTTTGCCAAGTTTGTAA (SEQ ID NO: 724) |
| YDR521W | GATCCCCGGGAATTGCCATGTTACTCACCATTAAAACATCTTTCCC (SEQ ID NO: 725) |
| YER167W | GATCCCCGGGAATTGCCATGTTAGTTGCTATTATCAAAATAAAAGAC (SEQ ID NO: 726) |
| YER123W | GATCCCCGGGAATTGCCATGTCAAAAAAAAAAAGGAAAAAGAGAAAAG (SEQ ID NO:727) |
| YDR415C | GATCCCCGGGAATTGCCATGTCACATTTTTCTAAATTCACTTAGCAC (SEQ ID NO: 728) |
| YEL052W | GATCCCCGGGAATTGCCATGTTAGTATGTAGGCTTAGTAACCCAA (SEQ ID NO: 729) |
| YDR536W | GATCCCCGGGAATTGCCATGTCAACCCTCAAAATTTGCTTTATCG (SEQ ID NO: 730) |
| YDR513W | GATCCCCGGGAATTGCCATGCTATTGAAATACCGGCTTCAATATTT (SEQ ID NO: 731) |
| YEL045C | GATCCCCGGGAATTGCCATGCTAGGAAAGGAGGTGGTTACGAA (SEQ ID NO: 732) |
| YEL041W | GATCCCCGGGAATTGCCATGTTAGATTGCAAAATGAGCCTGACGA (SEQ ID NO: 733) |
| Y0L238C | GATCCCCGGGAATTGCCATGCTAAATCTGGTAGACTTGCTGGC (SEQ ID NO: 734) |
| YBR282W | GATCCCCGGGAATTGCCATGTTATCCACGCTCCTTATAACATGAA (SEQ ID NO: 735) |
| YBR258C | GATCCCCGGGAATTGCCATGTTACGTACTTCCATTTGCTTCCTCT (SEQ ID NO: 736) |
| YCL001W-A | GATCCCCGGGAATTGCCATGTCAGTTCATCAAAATTGAAATTTCTAACCA (SEQ ID NO: 737) |
| YBR274W | GATCCCCGGGAATTGCCATGTCAGTTGGGAATTAGGATAATATCC (SEQ ID NO: 738) |
| YHR090C | GATCCCCGGGAATTGCCATGTCAGTTACGTTTTCTTTTCAGTTTGT (SEQ ID NO: 739) |
| YGR121C | GATCCCCGGGAATTGCCATGTTACCTATTGGCAGGATCTTCTTGA (SEQ ID NO: 740) |
| YGR127W | GATCCCCGGGAATTGCCATGTTACAATTTGAATTTAAACCTTTTTTCC (SEQ ID NO: 741) |
| YGR150C | GATCCCCGGGAATTGCCATGCTACATGTTAAGTTCTTGTTCCTCC (SEQ ID NO: 742) |
| YKL037W | GATCCCCGGGAATTGCCATGTTATATACTCAATCCAAAACAGGGAA (SEQ ID NO: 743) |
| YKL051W | GATCCCCGGGAATTGCCATGTCATACGACTACTTGAATAGATTCG (SEQ ID NO: 744) |
| YKL120W | GATCCCCGGGAATTGCCATGTTAATTATGGCCTAAAACTCTCGAC (SEQ ID NO: 745) |
| YKL011C | GATCCCCGGGAATTGCCATGTTAGTCATTGTTGTAAGTGTTCTGC (SEQ ID NO: 746) |
| YKL017C | GATCCCCGGGAATTGCCATGTTACAAATAATCGTCAATGTTGGGG (SEQ ID NO: 747) |
| YKL049C | GATCCCCGGGAATTGCCATGCTAAATAAACTGTCCCCTGATTCTT (SEQ ID NO: 748) |
| YKL132C | GATCCCCGGGAATTGCCATGCTATACTGGCAAGTGACAGTTGTG (SEQ ID NO: 749) |
| YGR126W | GATCCCCGGGAATTGCCATGTTAATCGAAAATTCTATGAAAAAACCC (SEQ ID NO: 750) |
| YKL070W | GATCCCCGGGAATTGCCATGTCAGAAACGCTCCACTTTACTTCG (SEQ ID NO: 751) |
| YKL058W | GATCCCCGGGAATTGCCATGTTACTCGCTCTTTTTTGAGTTACATG (SEQ ID NO: 752) |
| YHR130C | GATCCCCGGGAATTGCCATGCTAATTCCTGATGCCAAGTAACGA (SEQ ID NO: 753) |
| YIL070C | GATCCCCGGGAATTGCCATGTTAGTGGAAAAACTTCTTCATCTTTTC (SEQ ID NO: 754) |
| YHR195W | GATCCCCGGGAATTGCCATGTTAGTATCTAAATGGTTGAGAGTATG (SEQ ID NO: 755) |
| YIR022W | GATCCCCGGGAATTGCCATGCTACTCGCCCCCCAGCAGAG (SEQ ID NO: 756) |
| YJL089W | GATCCCCGGGAATTGCCATGTTAGAAGGTCGAGTTCAAAATATTCT (SEQ ID NO: 757) |
| YJL172W | GATCCCCGGGAATTGCCATGTTAAGCGTATTCGTTAACATTAACGA (SEQ ID NO: 758) |
| YHR113W | GATCCCCGGGAATTGCCATGTTAGACAACAATTTCAGATTCTATGG (SEQ ID NO: 759) |

-continued

| Gene | Reverse Seq |
|---|---|
| YHR175W | GATCCCCGGGAATTGCCATGTTAATGGCAGGCGAGGGAGCTG (SEQ ID NO: 760) |
| YGR212W | GATCCCCGGGAATTGCCATGCTAGTATAAATTTAAGTAATCTTTCATAT (SEQ ID NO: 761) |
| YJL024C | GATCCCCGGGAATTGCCATGTTATTGCCCCGTTGCCCATTGTG (SEQ ID NO: 762) |
| YGR180c | GATCCCCGGGAATTGCCATGTTAGAAGTCATCATCAAAGTTAATTTC (SEQ ID NO: 763) |
| YJL179W | GATCCCCGGGAATTGCCATGTTAATTCTTCATCAATGCCTTTAGATT (SEQ ID NO: 764) |
| YJL001W | GATCCCCGGGAATTGCCATGTTATAGTTGTTCATATTCATCAGGGT (SEQ ID NO: 765) |
| YJL208C | GATCCCCGGGAATTGCCATGTCAATTCCTTTTTTTGGAGGAGGT (SEQ ID NO: 766) |
| YJL152W | GATCCCCGGGAATTGCCATGTCACGCAGACATGCGACTGCG (SEQ ID NO: 767) |
| YJL131C | GATCCCCGGGAATTGCCATGTTACATTTCATTCATTTTTTTCTCTGA (SEQ ID NO: 768) |
| YJL151C | GATCCCCGGGAATTGCCATGCTAAGTACGGCCGGAAGAGAGC (SEQ ID NO: 769) |
| YLR441C | GATCCCCGGGAATTGCCATGTTACACAGTTTCCAAGACTTCGTC (SEQ ID NO: 770) |
| YLR415C | GATCCCCGGGAATTGCCATGCTACTTCCAAACAACTGGTCCAGA (SEQ ID NO: 771) |
| YLR212C | GATCCCCGGGAATTGCCATGTTATACTAATTTTATGATCACCGTCGG (SEQ ID NO: 772) |
| YLR029C | GATCCCCGGGAATTGCCATGTTATTTTCTGTATCTCCACAAGGAC (SEQ ID NO: 773) |
| YLL041C | GATCCCCGGGAATTGCCATGCTAGGCAAATGCCAAAGATTTTCTTA (SEQ ID NO: 774) |
| YLR105C | GATCCCCGGGAATTGCCATGCTAGTCTCTATTTTCTTCCGGGAAC (SEQ ID NO: 775) |
| YIL136W | GATCCCCGGGAATTGCCATGCTAGTCCTTTTTCGAGCTCCAGAA (SEQ ID NO: 776) |
| YLR215C | GATCCCCGGGAATTGCCATGCTAAGTTTCATTTCTCACTATCACTG (SEQ ID NO: 777) |
| YLR321C | GATCCCCGGGAATTGCCATGCTACATTCTCATTGTGGTTTCTAAG (SEQ ID NO: 778) |
| YMR260C | GATCCCCGGGAATTGCCATGTTAATCATAAATAGTTTCATAAGTGTGT (SEQ ID NO: 779) |
| YNL120C | GATCCCCGGGAATTGCCATGTCACTTCCTATGCAAAATGCTTAATA (SEQ ID NO: 780) |
| YLR407W | GATCCCCGGGAATTGCCATGTCAGTCATGGCATGCCTTGGCA (SEQ ID NO: 781) |
| YMR197C | GATCCCCGGGAATTGCCATGCTAAAATGAAGACAGCCACAATCTG (SEQ ID NO: 782) |
| YMR100W | GATCCCCGGGAATTGCCATGCTATTGATTGTTTGTTCCACGGACT (SEQ ID NO: 783) |
| YMR210W | GATCCCCGGGAATTGCCATGTTATGAAGTCCATGGTAAATTCGTG (SEQ ID NO: 784) |
| YMR318C | GATCCCCGGGAATTGCCATGTTACATGAGGTTCATGTTCATGTTAG (SEQ ID NO: 785) |
| YMR069W | GATCCCCGGGAATTGCCATGTTATTTTTTACTTAATTTCATCCATTTAG (SEQ ID NO: 786) |
| YNL076W | GATCCCCGGGAATTGCCATGTTATGTATCACAACTATTAAATTCAGTT (SEQ ID NO: 787) |
| YNL024C | GATCCCCGGGAATTGCCATGTTAATCTCTTTCAAAACAGACAGCAA (SEQ ID NO: 788) |
| YNL125C | GATCCCCGGGAATTGCCATGCTATTTTTCACTTTGGCTGTTGCC (SEQ ID NO: 789) |
| YNL029C | GATCCCCGGGAATTGCCATGTTAACTCTCTTGTCCCGATTTCTC (SEQ ID NO: 790) |
| YMR115W | GATCCCCGGGAATTGCCATGTTAGTTTCTCAAGTGACTATTGTGAA (SEQ ID NO: 791) |
| YNL244C | GATCCCCGGGAATTGCCATGTTACGAATCAGTCCGATTGGACTT (SEQ ID NO: 792) |
| YNL334C | GATCCCCGGGAATTGCCATGTTAAGCTGGAAGAGCCAATCTCTT (SEQ ID NO: 793) |
| YNR018W | GATCCCCGGGAATTGCCATGTTATTTCAAAGTCTTCAACAATTTTTCT (SEQ ID NO: 794) |
| YNL277W | GATCCCCGGGAATTGCCATGTTAGTCTTCATGCTTATCACAGAAC (SEQ ID NO: 795) |
| VOL118C | GATCCCCGGGAATTGCCATGTCACTTCAAAGTCTCTGGAATATGA (SEQ ID NO: 796) |
| YOL123W | GATCCCCGGGAATTGCCATGTTATTCGTCTTCTTCCAAAGTTTGAG (SEQ ID NO: 797) |
| YOR020C | GATCCCCGGGAATTGCCATGCTATGAGCGATCCCGTTTTGTGAA (SEQ ID NO: 798) |

-continued

| Gene | Reverse Seq |
|---|---|
| YOL116W | GATCCCGGGAATTGCCATGTTAATAATTGAATTTAATTTTACTTCTGTT (SEQ ID NO: 799) |
| YOR305W | GATCCCCGGGAATTGCCATGTCACCGACTCATTTGTTAAGCTTG (SEQ ID NO: 800) |
| YPL267W | GATCCCCGGGAATTGCCATGTTACTCATCTTCATAGACGTGGAAG (SEQ ID NO: 801) |
| YPL229W | GATCCCCGGGAATTGCCATGCTAACATTTCTTATTATCTCTATATATC (SEQ ID NO: 802) |
| YPL038W | GATCCCCGGGAATTGCCATGCTAACTGCTTTTTTCGTGTTGAGTA (SEQ ID NO: 803) |
| YPR047W | GATCCCCGGGAATTGCCATGTCATTTTGTCCCTTTATATCAATTTTT (SEQ ID NO: 804) |
| YPL011C | GATCCCCGGGAATTGCCATGTTAGCGTTTTTTTTGCCTTCTTC (SEQ ID NO: 805) |
| YPR148C | GATCCCCGGGAATTGCCATGCTAAATTTCCAAACCATTTAGAACTTT (SEQ ID NO: 806) |
| VOL103W | GATCCCCGGGAATTGCCATGCTAAGACTTGAAATTAATTAATTCGGG (SEQ ID NO: 807) |
| VOR016C | GATCCCCGGGAATTGCCATGTCACTGTATCTCGCTGTCACAATC (SEQ ID NO: 808) |
| YPL079W | GATCCCCGGGAATTGCCATGCTATTGTAATTCCCTTATAGTGTTCA (SEQ ID NO: 809) |
| YOR260W | GATCCCCGGGAATTGCCATGTTATTTAAGCTCGAAATGGCTATTGA (SEQ ID NO: 810) |
| YOR360C | GATCCCCGGGAATTGCCATGTCATTGTGGAAGAGGTCTTCTAGG (SEQ ID NO: 811) |
| YDL060W | GATCCCCGGGAATTGCCATGTTACATACCATTCCAAGGTAACGAA (SEQ ID NO: 812) |
| YDL005C | GATCCCCGGGAATTGCCATGCTATATATTGAAGCCGCTGAGGTC (SEQ ID NO: 813) |
| YPL210C | GATCCCCGGGAATTGCCATGCTACTTACGTACTAAAATAGTCTCTT (SEQ ID NO: 814) |
| YMR118C | GATCCCCGGGAATTGCCATGTTACTGAGCCAGTAAATACGTTCCT (SEQ ID NO: 815) |
| YPR052C | GATCCCCGGGAATTGCCATGCTAAGCCAAAGTGGCGTTATATAAC (SEQ ID NO: 816) |
| YLR224W | GATCCCCGGGAATTGCCATGTCATCTTCGAAGATAAGGGGTATTC (SEQ ID NO: 817) |
| YLR275W | GATCCCCGGGAATTGCCATGTTACTCAACAGGGGTTTTTAACACA (SEQ ID NO: 818) |
| YMR154C | GATCCCCGGGAATTGCCATGTTATTTTGGTATCACATCATCGGAG (SEQ ID NO: 819) |
| YDR205W | GATCCCCGGGAATTGCCATGTCAATTTGCTATAGGCTGTAGCGG (SEQ ID NO: 820) |
| YPR037C | GATCCCCGGGAATTGCCATGTTAGAACTGAATTATTTCACATTGTCT (SEQ ID NO: 821) |
| YNR008W | GATCCCCGGGAATTGCCATGTTACATTGGGAAGGGCATCTGAGA (SEQ ID NO: 822) |
| YOR084W | GATCCCCGGGAATTGCCATGTTACAGTTTTTGTTTAGTCGTTTTAAC (SEQ ID NO: 823) |
| YGR054W | GATCCCCGGGAATTGCCATGTTATTCATCCTTCCAACCCAACTTT (SEQ ID NO: 824) |
| YGL106W | GATCCCCGGGAATTGCCATGTCATTGTCTCAAAACATCTTCGATG (SEQ ID NO: 825) |
| YAL067C | GATCCCCGGGAATTGCCATGTTATTTTTCATCAGATACTGATAAGGT (SEQ ID NO: 826) |
| YIL023C | GATCCCCGGGAATTGCCATGTCAATGCTCATCCATGAGCGCCA (SEQ ID NO: 827) |
| YBR064W | GATCCCCGGGAATTGCCATGCTAAAATATGGAGGAACTAGGTTTAA (SEQ ID NO: 828) |
| b0019 | TTGCTCTTCGTTAAACTGATGGACGCAAACGAACG (SEQ ID NO: 829) |
| b2148 | TTGCTCTTCGTTATTTCTTACGCGCGTATTTCAGTG (SEQ ID NO: 830) |
| b2796 | TTGCTCTTCGTTAGCTGAACAGAGAGTAGAAGATT (SEQ ID NO: 831) |
| b2082 | TTGCTCTTCGTTACATCCACATAATTTGCTGCCC (SEQ ID NO: 832) |
| b0124 | TTGCTCTTCGTTACTTCACATCATCCGGCAGCG (SEQ ID NO: 833) |
| b3116 | TTGCTCTTCGTTAAAACAGTTTGTATACGATGTTCAG (SEQ ID NO: 834) |

-continued

| Gene | Reverse Seq |
|---|---|
| b1830 | TTGCTCTTCGTTACTTGACGGGAGCGGGTTGT (SEQ ID NO: 835) |
| b1453 | TTGCTCTTCGTTAACTCGCCGTTTCAGGCTTAAA (SEQ ID NO: 836) |
| b2664 | TTGCTCTTCGTTAATTGCCAGCCATCGCCTG (SEQ ID NO: 837) |
| b2799 | TTGCTCTTCGTTACCAGGCGGTATGGTAAAGCT (SEQ ID NO: 838) |
| b3327 | TTGCTCTTCGTTAATTAATCATTGAGTTAAGTTGAAGA (SEQ ID NO: 839) |
| b0970 | TTGCTCTTCGTTAATCGCGGCTAGCGAAGCCC (SEQ ID NO: 840) |
| YER003C | GATCCCCGGGAATTGCCATGCTAATTTGGTTCCACAAAGGCTCTA (SEQ ID NO: 841) |
| YCL027W | GATCCCCGGGAATTGCCATGTCAGTCGTATTCTTGGAGACAGTC (SEQ ID NO: 842) |
| YBR112C | GATCCCCGGGAATTGCCATGTTAGTCGTCGTAGTTTTCATCTTCT (SEQ ID NO: 843) |
| YNL079C | GATCCCCGGGAATTGCCATGTCACAAGTTTTCCAGAGATGCAGC (SEQ ID NO: 844) |
| YFR042W | GATCCCCGGGAATTGCCATGTCATTTTGTTAATAGTTTTTTGTATGCT (SEQ ID NO: 845) |
| YER137C | GATCCCCGGGAATTGCCATGTTATTTCTTGGGTATAACTGTCAGTC (SEQ ID NO: 846) |
| YKL103C | GATCCCCGGGAATTGCCATGTCACAACTCGCCGAATTCATGGTA (SEQ ID NO: 847) |
| YNL090W | GATCCCCGGGAATTGCCATGTTATAAAATTATGCAACAGTTAGCCC (SEQ ID NO: 848) |
| YGR161C | GATCCCCGGGAATTGCCATGCTATTTCAATGAACCAGTTTGGAATC (SEQ ID NO: 849) |
| YDR071C | GATCCCCGGGAATTGCCATGCTAGTTGTCGTATTCTTCCTTAATTA (SEQ ID NO: 850) |

Vector Preparation

The preferred binary vector 1bxbigResgen for yeast and 1bxSuperCoLic for *E. coli*, which is based on the modified pPZP binary vector backbone (comprising the kanamycin-gene for bacterial selection; Hajukiewicz, P. et al., 1994, Plant Mol. Biol., 25: 989-994) carried the selection marker bar-gene (De Block et al., 1987, EMBO J. 6, 2513-2518) driven by the mas1' promotor (Velten et al., 1984, EMBO J. 3, 2723-2730; Mengiste, Amedeo and Paszkowski, 1997, Plant J., 12, 945-948) on its T-DNA. In addition the T-DNA contained the strong double 35S (Kay et al., 1987, Science 236, 1299-1302) for yeast or Super promotor (Ni et al., 1995, Plant Journal 7, 661-676) for *E. coli* in front of a cloning cassette followed by the nos-terminator (Depicker A. Stachel S. Dhaese P. Zambryski P. Goodman H M. Nopaline synthase: transcript mapping and DNA sequence. Journal of Molecular & Applied Genetics. 1(6):561-73, 1982.). The cloning cassette consists of the following sequence:

Yeast: 5-GGAATTCCAGCTGACCACCATGGCAAT-TCCCGGGGATC-3'(SEQ ID NO: 851) or

*E. coli*: 5'-TTG CTC TTC CAT GGC AAT GAT TAA TTA ACG AAG AGC M-3' (SEQ ID NO: 852), respectively.

Other selection marker systems, like the AHAS marker or other promoters, e.g. superpromoter (see above), 35S promotor (see above), Ubiquitin promotor (Callis et al., J. Biol. Chem., 1990, 265: 12486-12493; U.S. Pat. No. 5,510,474; U.S. Pat. No. 6,020,190; Kawalleck et al., Plant. Molecular Biology, 1993, 21: 673-684) or 34S promoter (GenBank Accession numbers M59930 and X16673) were similar useful for the instant invention and are known to a person skilled in the art. The vector was linearised with EcoR and SmaI for yeast or SmaI and SacI for *E. coli* using the standard protocol provided by the supplier (MBI Fermentas, Germany) and purified using Qiagen columns (Qiagen, Hilden, Germany).

Ligation and Transformation

Present ORF fragments (~100 ng) were digested by EcoRI and SmaI for yeast and SmaI and SacI for *E. coli* using the standard protocol provided by the supplier (MBI Fermentas, Germany), purified using Qiagen columns (Qiagen, Hilden, Germany) and were ligated into the cloning cassette of the binary vector systems (~30 ng) using standard procedures (Maniatis et al.).

In the case of internal EcoRI, SmaI and SacI restriction sites a blunt end cloning procedure was applied. The undigested ORF fragments were directly purified and ligated into the cloning cassette of the binary vector. In this case the EcoRI site was refilled by Klenow reaction and the SacI site blunted Pfu DNA polymerase.

Ligation products were transformed into *E. coli* (DH5alpha) using a standard heat shock protocol (Maniatis et al.). Transformed colonies were grown on LB media and selected by respective antibiotica (Km) for 16 h at 37° C. Positive clones were identified by control PCR reactions using a combination of a vector specific and the respective ORF specific primers.

Plasmidpreparation

Plasmid DNA was prepared from positive clones using standard protocols (Qiagen Hilden, Germany).

Transformation of *Agrobacteria*

Plasmids were transformed into *Agrobacterium tumefaciens* (GV3101 pMP90; Koncz and Schell, 1986, Mol. Gen. Genet. 204: 383-396) using heat shock or electroporation protocols. Transformed colonies were grown on YEP media and selected by respective antibiotics (Rif/Gent/Km) for 2d at 28° C. These *Agrobacterium* cultures were used for the plant transformation.

*Arabidopsis thaliana* was grown and transformed according to standard conditions Bechtold 1993 (Bechtold, N., Ellis, J., Pelletier, G. 1993. In planta *Agrobacterium* mediated gene transfer by infiltration of *Arabidopsis thaliana* plants C.R.

Acad. Sci. Paris. 316:1194-1199); Bent et al. 1994 (Bent, A., Kunkel, B. N., Dahlbeck, D., Brown, K. L., Schmidt, R., Giraudat, J., Leung, J., and Staskawicz, B. J. 1994; PPCS2 of *Arabidopsis thaliana*: A leucin-rich repeat class of plant disease resistant genes; Science 265: 1856-1860).

Transgenic *A. thaliana* plants were grown individually in pots containing a 4:1 (v/v) mixture of soil and quartz sand in a York growth chamber. Standard growth conditions were: photoperiod of 16 h light and 8 h dark, 20° C., 60% relative humidity, and a photon flux density of 150 µE. To induce germination, sown seeds were kept at 4° C., in the dark, for 3 days. Plants were watered daily until they were approximately 3 weeks old at which time drought was imposed by withholding water. Parallely, the relative humidity was reduced in 10% increments every second day to 20%. After approximately 12 days of withholding water, most plants showed visual symptoms of injury, such as wilting and leaf browning, whereas tolerant plants were identified as being visually turgid and healthy green in color. Plants were scored for symptoms of drought injury in comparison to neighbouring plants for 3 days in succession.

Three successive experiments were conducted. In the first experiment, 10 independent T2 lines were sown for each gene being tested. The percentage of plants not showing visual symptoms of injury was determined. In the second experiment, the lines that had been scored as tolerant in the first experiment were put through a confirmation screen according to the same experimental procedures. In this experiment, plants of each tolerant line were grown and treated as before. In the third experiment, at least 7 replicates of the most tolerant line were grown and treated as before. The average and maximum number of days of drought survival after wild-type control had visually died were determined. Additionally measurements of chlorophyll fluorescence were made in stressed and non-stressed plants using a Mini-PAM (Heinz Walz GmbH, Effeltrich, Germany).

In the first experiment, after 12 days of drought, the control, non-transgenic *Arabidopsis thaliana* and most transgenic lines expressing other transgenes in the test showed extreme visual symptoms of stress including necrosis and cell death. Several plants expressing the genes retained viability as shown by their turgid appearance and maintenance of green color.

The second experiment compared a smaller number of independent transgenic lines for each gene but a greater number of progeny within each independent transformation event. This experiment confirmed the previous results. Those lines containing the specific SRP encoding yeast genes survived longer than the controls. In some cases the transgenic line survived more than 3 days after the controls had died.

According to the results of the first and second experiments some major lines containing the specific SRP encoding yeast genes were identified, which showed the best results with regard to the average days of survival after wild type and/or the hit percentage.

In a third experiment these major lines were tested with multiple replicates (4-80 plants per line). The average number of days the plants of the major line survived longer than wild-type was measured. I.e., the number '1' means that, on average, the plants overexpressing this ORF, on averaged survived 1 day longer than wild-type. The value for WT in this column is '0'. The results are summmarised in table 3.

TABLE 3

Drought tolerance of transgenic *Arabidopsis thaliana* expressing the various SRP encoding genes from *Saccharomyces cerevisiae* or *E. coli* after imposition of drought stress on 3 week old plants in a third experiment using several plants from one transgenic line (experiment 3). Drought tolerance is measured for the indicated number of transgenic plants (Plants tested) as the average number of days (Average days of survival after WT) that the transgenic plants survived after the control (untransformed wild type). The hit percentage indicates the fraction of the tested plants of the major line that was actually resistant, i.e. the number '50' indicates that half of the tested plants were resistant (survived longer than WT). For WT, this column has the value '0'.

| Sequ. ID No. | Gene | Plants tested | Average days of survival after WT |
|---|---|---|---|
| 1 | YGL263W | 12 | 1.17 |
| 3 | YGR004W | 11 | 1.36 |
| 5 | YGR014W | 11 | 0.82 |
| 7 | YGL239C | 13 | 2.4 |
| 9 | YBL060W | 14 | 1.6 |
| 11 | YGL166W | 14 | 1.07 |
| 13 | YDL202W | 15 | 0.47 |
| 15 | YAL046C | 14 | 1.9 |
| 17 | YDR101C | 14 | 3.57 |
| 19 | YDR108W | 14 | 0.5 |
| 21 | YAL064W | 33 | 2.29 |
| 23 | YDR134C | 13 | 0.8 |
| 26 | YFL031w | 13 | 1.3 |
| 28 | YFL052W | 14 | 1.1 |
| 30 | YFL042C | 11 | 1.3 |
| 32 | YBR025C | 11 | 1.4 |
| 34 | YER174C | 22 | 1.05 |
| 36 | YBR051W | 10 | 1.2 |
| 38 | YER175C | 11 | 1.7 |
| 40 | YDR521W | 14 | 0.5 |
| 42 | YER167W | 35 | 0.66 |
| 44 | YER123W | 11 | 2.2 |
| 46 | YDR415C | 7 | 2.71 |
| 48 | YEL052W | 4 | 1.5 |
| 50 | YDR536W | 14 | 1.5 |
| 52 | YDR513W | 7 | 3.14 |
| 54 | YEL045C | 14 | 1.64 |
| 56 | YEL041W | 13 | 1.77 |
| 58 | YDR415C | 7 | 2.71 |

TABLE 3-continued

Drought tolerance of transgenic *Arabidopsis thaliana* expressing the various SRP encoding genes from *Saccharomyces cerevisiae* or *E. coli* after imposition of drought stress on 3 week old plants in a third experiment using several plants from one transgenic line (experiment 3). Drought tolerance is measured for the indicated number of transgenic plants (Plants tested) as the average number of days (Average days of survival after WT) that the transgenic plants survived after the control (untransformed wild type). The hit percentage indicates the fraction of the tested plants of the major line that was actually resistant, i.e. the number '50' indicates that half of the tested plants were resistant (survived longer than WT). For WT, this column has the value '0'.

| Sequ. ID No. | Gene | Plants tested | Average days of survival after WT |
|---|---|---|---|
| 60 | YDL238C | 35 | 1.2 |
| 62 | YBR282W | 14 | 1.79 |
| 64 | YBR258C | 9 | 3.4 |
| 66 | YCL001W-A | 36 | 1.78 |
| 68 | YBR274W | 14 | 2 |
| 70 | YHR090C | 8 | 4.5 |
| 72 | YGR121C | 40 | 1.6 |
| 74 | YGR127W | 8 | 1.4 |
| 76 | YGR150C | 12 | 2.6 |
| 78 | YKL037W | 14 | 0.79 |
| 80 | YKL051W | 16 | 2.4 |
| 82 | YKL120W | 14 | 0.64 |
| 84 | YKL011C | 12 | 1.9 |
| 86 | YKL017C | 10 | 1.8 |
| 88 | YKL049C | 80 | 1.92 |
| 90 | YKL132C | 33 | 1.82 |
| 92 | YGR126W | 8 | 2.3 |
| 94 | YKL070W | 14 | 2.1 |
| 96 | YKL058W | 9 | 1.44 |
| 98 | YHR130C | 9 | 1.8 |
| 100 | YIL070C | 13 | 0.69 |
| 102 | YHR195W | 14 | 1.9 |
| 104 | YIR022W | 14 | 1.07 |
| 106 | YJL089W | 14 | 0.86 |
| 108 | YJL172W | 11 | 0.82 |
| 110 | YHR113W | 15 | 2 |
| 112 | YHR175W | 9 | 0.78 |
| 114 | YJL024C | 13 | 0.69 |
| 116 | YGR180c | 14 | 2.9 |
| 118 | YJL179W | 18 | 1.3 |
| 120 | YJL001W | 14 | 1.6 |
| 122 | YJL208C | 12 | 1.4 |
| 124 | YJL152W | 13 | 1.3 |
| 126 | YJL131C | 14 | 0.6 |
| 128 | YJL151C | 14 | 1.9 |
| 130 | YLR441C | 10 | 2 |
| 132 | YLR415C | 14 | 1.6 |
| 134 | YLR212C | 13 | 0.64 |
| 136 | YLR029C | 14 | 1.56 |
| 137 | YLL041C | 13 | 0.92 |
| 139 | YLR105C | 14 | 0.86 |
| 141 | YIL136W | 8 | 2.25 |
| 143 | YLR215C | 13 | 1.77 |
| 145 | YLR321C | 14 | 1.29 |
| 147 | YMR260C | 11 | 2.09 |
| 149 | YNL120C | 7 | 2 |
| 151 | YLR407W | 12 | 1.17 |
| 153 | YMR197C | 14 | 0.57 |
| 155 | YMR100W | 12 | 1.25 |
| 157 | YMR210W | 10 | 1.1 |
| 159 | YMR318C | 13 | 0.85 |
| 161 | YMR069W | 8 | 1.25 |
| 163 | YNL076W | 13 | 1.31 |
| 165 | YNL024C | 13 | 1.08 |
| 167 | YNL125C | 4 | 1.75 |
| 169 | YNL029C | 13 | 1.92 |
| 171 | YMR115W | 12 | 0.75 |

TABLE 3-continued

Drought tolerance of transgenic *Arabidopsis thaliana* expressing the various SRP encoding genes from *Saccharomyces cerevisiae* or *E. coli* after imposition of drought stress on 3 week old plants in a third experiment using several plants from one transgenic line (experiment 3). Drought tolerance is measured for the indicated number of transgenic plants (Plants tested) as the average number of days (Average days of survival after WT) that the transgenic plants survived after the control (untransformed wild type). The hit percentage indicates the fraction of the tested plants of the major line that was actually resistant, i.e. the number '50' indicates that half of the tested plants were resistant (survived longer than WT). For WT, this column has the value '0'.

| Sequ. ID No. | Gene | Plants tested | Average days of survival after WT |
|---|---|---|---|
| 173 | YNL244C | 11 | 1.55 |
| 175 | YNL334C | 14 | 1.5 |
| 177 | YNR018W | 14 | 1.29 |
| 179 | YNL277W | 14 | 1.14 |
| 181 | YOL118C | 14 | 1.71 |
| 183 | YOL123W | 14 | 0.71 |
| 185 | YOR020C | 12 | 1.83 |
| 187 | YOL116W | 13 | 1.08 |
| 189 | YOR305w | 15 | 1.2 |
| 191 | YPL267W | 6 | 2.5 |
| 193 | YPL229w | 5 | 2 |
| 195 | YPL038W | 10 | 1.3 |
| 197 | YPR047W | 11 | 1 |
| 199 | YPL011C | 12 | 0.75 |
| 201 | YPR148C | 10 | 1.1 |
| 203 | YOL103W | 12 | 0.75 |
| 205 | YOR016C | 14 | 0.79 |
| 207 | YPL079W | 15 | 1.33 |
| 209 | YOR260W | 7 | 1.29 |
| 211 | YOR360C | 15 | 1.53 |
| 213 | YDL060W | 15 | 0.67 |
| 215 | YDL005C | 15 | 1 |
| 217 | YPL210C | 15 | 1.13 |
| 219 | YMR118C | 14 | 1.14 |
| 221 | YPR052C | 14 | 1.07 |
| 223 | YLR224W | 10 | 2.1 |
| 225 | YLR275W | 9 | 2.44 |
| 227 | YMR154C | 15 | 1.27 |
| 229 | YDR205W | 12 | 1.08 |
| 231 | YPR037C | 12 | 2.17 |
| 233 | YNR008W | 14 | 2.29 |
| 235 | YOR084W | 10 | 2.2 |
| 237 | YGR054W | 14 | 1.5 |
| 239 | YGL106W | 13 | 3.46 |
| 241 | YAL067C | 13 | 1.62 |
| 243 | YIL023c | 15 | 1.73 |
| 245 | YBR064W | 15 | 1.13 |
| 247 | b0020 | 13 | 0.78 |
| 249 | b2148 | 15 | 3.13 |
| 251 | b2796 | 15 | 2.33 |
| 253 | b2082 | 14 | 2.43 |
| 255 | b0124 | 15 | 2.87 |
| 257 | b3116 | 15 | 1.07 |
| 259 | b1830 | 15 | 2.07 |
| 261 | b1453 | 14 | 2.29 |
| 263 | b2664 | 13 | 1.85 |
| 265 | b2799 | 15 | 1.87 |
| 267 | b3327 | 15 | 1.47 |
| 269 | b0970 | 15 | 1.33 |
| 271 | YER003C | 5 | 1 |
| 273 | YCL027W | 9 | 0.56 |
| 275 | YBR112C | 10 | 0.5 |
| 277 | YNL079C | 9 | 0.67 |
| 279 | YFR042W | 9 | 0.78 |
| 281 | YER137C | 3 | 0 |
| 283 | YKL103C | 9 | 1 |
| 285 | YNL090W | 6 | 0.83 |

TABLE 3-continued

Drought tolerance of transgenic *Arabidopsis thaliana* expressing the various SRP encoding genes from *Saccharomyces cerevisiae* or *E. coli* after imposition of drought stress on 3 week old plants in a third experiment using several plants from one transgenic line (experiment 3). Drought tolerance is measured for the indicated number of transgenic plants (Plants tested) as the average number of days (Average days of survival after WT) that the transgenic plants survived after the control (untransformed wild type). The hit percentage indicates the fraction of the tested plants of the major line that was actually resistant, i.e. the number '50' indicates that half of the tested plants were resistant (survived longer than WT). For WT, this column has the value '0'.

| Sequ. ID No. | Gene | Plants tested | Average days of survival after WT |
|---|---|---|---|
| 287 | YGR161C | 7 | 0.86 |
| 289 | YDR071C | 9 | 0.78 |

In a further experiment, for individual major lines, other lines containing the same gene contruct, but resulting from a different transformation event were tested. In these lines, the specific SRP encoding yeast genes is incorporated at a different site in the plant genom. The results are summmarised in table 4 in accordance to table 3. The results demonstrate the dependence of the stress tolerance and/or resistance in plants on the expression of the SRP, rather than the insertion event.

TABLE 4

Drought tolerance at transgenic *Arabidopsis thaliana* expressing selected SRP encoding genes from *Saccharomyces cerevisiae* or *E. coli* after imposition of drought stress on 3 week old plants in a third experiment using one plant from several independent transgenic lines each (experiment 3). Drought tolerance is measured for the indicated number of transgenic plants (Plants tested) as the average number of days (Average days of survival after WT) that the transgenic plants survived after the control (untransformed wild type). The hit percentage indicates the fraction of the tested plants of the major line that was actually resistant, i.e. the number '50' indicates that half of the tested plants were resistant (survived longer than WT). For WT, this column has the value '0'.

| Sequ. ID No. | Gene | Number other lines tested | Average days of survival after WT |
|---|---|---|---|
| 1 | YGL263W | 7 | 1.43 |
| 3 | YGR004W | 8 | 1 |
| 5 | YGR014W | 8 | 0.75 |
| 7 | YGL239C | 5 | 1 |
| 9 | YBL060W | 8 | 2 |
| 11 | YGL166W | 8 | 0.63 |
| 13 | YDL202W | 8 | 0.25 |
| 15 | YAL046C | 7 | 1.3 |
| 17 | YDR101C | 9 | 1.1 |
| 19 | YDR108W | 9 | 0.22 |
| 21 | YAL064W | 8 | 3 |
| 23 | YDR134C | 6 | 2.2 |
| 26 | YFL031w | 9 | 2.3 |
| 28 | YFL052W | 5 | 1.4 |
| 32 | YBR025C | 5 | 1.2 |
| 34 | YER174C | 9 | 0.5 |
| 36 | YBR051W | 6 | 1.3 |
| 38 | YER175C | 4 | 1.4 |
| 40 | YDR521W | 3 | 0.7 |
| 44 | YER123W | 6 | 0.3 |
| 46 | YDR415C | 7 | 0.4 |
| 48 | YEL052W | 3 | 1.33 |
| 50 | YDR536W | 8 | 1.25 |
| 52 | YDR513W | 4 | 1.5 |
| 54 | YEL045C | 5 | 1.2 |
| 56 | YEL041W | 8 | 0.88 |
| 60 | YDL238C | 6 | 0.17 |
| 62 | YBR282W | 9 | 2.2 |
| 64 | YBR258C | 7 | 1.7 |
| 66 | YCL001W-A | 7 | 0.57 |
| 68 | YBR274W | 9 | 0.78 |
| 70 | YHR090C | 6 | 2.7 |
| 72 | YGR121C | 9 | 0.8 |
| 74 | YGR127W | 6 | 2.5 |

TABLE 4-continued

Drought tolerance at transgenic *Arabidopsis thaliana* expressing selected SRP encoding genes from *Saccharomyces cerevisiae* or *E. coli* after imposition of drought stress on 3 week old plants in a third experiment using one plant from several independent transgenic lines each (experiment 3). Drought tolerance is measured for the indicated number of transgenic plants (Plants tested) as the average number of days (Average days of survival after WT) that the transgenic plants survived after the control (untransformed wild type). The hit percentage indicates the fraction of the tested plants of the major line that was actually resistant, i.e. the number '50' indicates that half of the tested plants were resistant (survived longer than WT). For WT, this column has the value '0'.

| Sequ. ID No. | Gene | Number other lines tested | Average days of survival after WT |
|---|---|---|---|
| 76 | YGR150C | 5 | 3 |
| 78 | YKL037W | 9 | 0.78 |
| 80 | YKL051W | 5 | 1.8 |
| 82 | YKL120W | 8 | 0.63 |
| 84 | YKL011C | 5 | 1.4 |
| 86 | YKL017C | 5 | 0.6 |
| 88 | YKL049C | 9 | 1.4 |
| 90 | YKL132C | 7 | 0.7 |
| 92 | YGR126W | 6 | 1.3 |
| 94 | YKL070W | 6 | 2 |
| 96 | YKL058W | 8 | 0.88 |
| 98 | YHR130C | 9 | 2.1 |
| 100 | YIL070C | 7 | 0.71 |
| 102 | YHR195W | 9 | 2.1 |
| 104 | YIR022W | 9 | 1.22 |
| 106 | YJL089W | 7 | 0.6 |
| 108 | YJL172W | 4 | 1 |
| 110 | YHR113W | 7 | 1.6 |
| 112 | YHR175W | 3 | 1 |
| 114 | YJL024C | 6 | 1.33 |
| 116 | YGR180c | 8 | 2.7 |
| 118 | YJL179W | 8 | 1.8 |
| 120 | YJL001W | 9 | 0.7 |
| 122 | YJL208C | 6 | 1.7 |
| 124 | YJL152W | 8 | 0.3 |
| 126 | YJL131C | 6 | 1 |
| 128 | YJL151C | 8 | 1.6 |
| 130 | YLR441C | 7 | 2.6 |
| 132 | YLR415C | 9 | 0.3 |
| 134 | YLR212C | 7 | 2.14 |
| 136 | YLR029C | 8 | 0.25 |
| 137 | YLL041C | 7 | 0.86 |
| 139 | YLR105C | 7 | 0.29 |
| 141 | YIL136W | 9 | 1.75 |
| 143 | YLR215C | 8 | 1.25 |
| 145 | YLR321C | 7 | 0.86 |
| 147 | YMR260C | 8 | 0.88 |
| 149 | YNL120C | 9 | 1.56 |
| 151 | YLR407W | 5 | 0.4 |
| 153 | YMR197C | 9 | 1.22 |
| 155 | YMR100W | 8 | 0.88 |
| 157 | YMR210W | 8 | 0.88 |
| 159 | YMR318C | 8 | 0.63 |
| 161 | YMR069W | 9 | 0.44 |
| 163 | YNL076W | 4 | 1.75 |
| 165 | YNL024C | 9 | 1.78 |
| 167 | YNL125C | 7 | 2.14 |
| 169 | YNL029C | 9 | 1.88 |
| 171 | YMR115W | 9 | 1.44 |
| 173 | YNL244C | 8 | 0.25 |
| 175 | YNL334C | 9 | 1.33 |
| 177 | YNR018W | 9 | 1.22 |
| 179 | YNL277W | 8 | 1 |
| 181 | YOL118C | 9 | 0.89 |
| 183 | YOL123W | 8 | 0.88 |

TABLE 4-continued

Drought tolerance at transgenic Arabidopsis thaliana expressing selected SRP encoding genes from Saccharomyces cerevisiae or E. coli after imposition of drought stress on 3 week old plants in a third experiment using one plant from several independent transgenic lines each (experiment 3). Drought tolerance is measured for the indicated number of transgenic plants (Plants tested) as the average number of days (Average days of survival after WT) that the transgenic plants survived after the control (untransformed wild type). The hit percentage indicates the fraction of the tested plants of the major line that was actually resistant, i.e. the number '50' indicates that half of the tested plants were resistant (survived longer than WT). For WT, this column has the value '0'.

| Sequ. ID No. | Gene | Number other lines tested | Average days of survival after WT |
|---|---|---|---|
| 185 | YOR020C | 9 | 0.44 |
| 187 | YOL116W | 9 | 1.67 |
| 189 | YOR305w | 7 | 0.28 |
| 191 | YPL267W | 4 | 0.75 |
| 193 | YPL229w | 5 | 1.6 |
| 195 | YPL038W | 5 | 0.4 |
| 197 | YPR047W | 2 | 1 |
| 199 | YPL011C | 6 | 0.5 |
| 201 | YPR148C | 9 | 0.33 |
| 203 | YOL103W | 9 | 0.33 |
| 205 | YOR016C | 9 | 0.56 |
| 211 | YOR360C | 8 | 0.38 |
| 213 | YDL060W | 8 | 0.5 |
| 215 | YDL005C | 9 | 0.44 |
| 217 | YPL210C | 8 | 1.5 |
| 219 | YMR118C | 10 | 1.1 |
| 221 | YPR052C | 7 | 0.86 |
| 223 | YLR224W | 9 | 1.22 |
| 225 | YLR275W | 8 | 1.75 |
| 227 | YMR154C | 9 | 1.11 |
| 229 | YDR205w | 4 | 1 |
| 231 | YPR037C | 5 | 3.4 |
| 233 | YNR008W | 8 | 0.75 |
| 235 | YOR084W | 8 | 0.5 |
| 239 | YGL106W | 7 | 2.14 |
| 241 | YAL067C | 6 | 1.83 |
| 243 | YIL023c | 1 | 3 |
| 245 | YBR064W | 7 | 0.71 |
| 247 | b0020 | 4 | 1.5 |
| 249 | b2148 | 10 | 0.1 |
| 251 | b2796 | 11 | 0.72 |
| 253 | b2082 | 9 | 1.22 |
| 255 | b0124 | 9 | 3.3 |
| 257 | b3116 | 8 | 1 |
| 259 | b1830 | 7 | 1.71 |
| 261 | b1453 | 8 | 1.13 |
| 263 | b2664 | 9 | 1 |
| 267 | b3327 | 10 | 0.8 |
| 269 | b0970 | 8 | 1.5 |
| 271 | YER003C | 12 | 2.08 |
| 273 | YCL027W | 14 | 2.14 |
| 275 | YBR112C | 11 | 3.3 |
| 277 | YNL079C | 13 | 2.69 |
| 279 | YFR042W | 7 | 2.3 |
| 281 | YER137C | 13 | 2.2 |
| 283 | YKL103C | 10 | 2.8 |
| 285 | YNL090W | 12 | 4.33 |
| 287 | YGR161C | 12 | 2.7 |
| 289 | YDR071C | 11 | 3 |

Chlorophyll fluorescence measurements of photosynthetic yield confirmed that severe drought stress completely inhibited photosynthesis in the control plants, but the transgenic major lines maintained photosynthetic function longer (Table 5).

TABLE 5

Drought tolerance of transgenic Arabidopsis thaliana expressing the various SRP encoding genes from Saccharomyces cerevisiae or E. coli after imposition of drought stress on 3 week old plants in a third experiment using several plants from one transgenic line (experiment 3). Drought tolerance is reported as photosynthetic yield measured by chlorophyll fluorescence measured at three different time point during the drought stress experiment, and compared to the untransformed wild type control. For each transgenic line, the average of 5 replicate plants is indicated, the wild type value is the average of 20-25 plants measured in the same experiment.

| Sequ. ID No. | Gene | Photosynthetic yield 6 days after final watering | wild type | Photosynthetic yield 10 days after final watering | wild type | Photosynthetic yield 14 days after final watering | wild type |
|---|---|---|---|---|---|---|---|
| 1 | YGL263W | 751 | 766 | 765 | 654 | 264 | 106 |
| 3 | YGR004W | 759 | 766 | 755 | 654 | 246 | 106 |
| 5 | YGR014W | 759 | 766 | 752 | 654 | | |
| 7 | YGL239C | 782 | 757 | 786 | 610 | | |
| 9 | YBL060W | 743 | 757 | 782 | 610 | 108 | 16 |
| 11 | YGL166W | 752 | 736 | 747 | 709 | | |
| 13 | YDL202W | 790 | 766 | 508 | 548 | | |
| 15 | YAL046C | 788 | 760 | 756 | 549 | 216 | 20 |
| 19 | YDR108W | 756 | 736 | 739 | 709 | 0 | 20 |
| 23 | YDR134C | 757 | 760 | 765 | 549 | 273 | 20 |
| 26 | YFL031w | 763 | 760 | 766 | 549 | 784 | 20 |
| 28 | YFL052W | 757 | 757 | 753 | 610 | | |
| 30 | YFL042C | 743 | 757 | 780 | 610 | | |
| 32 | YBR025C | 763 | 760 | 762 | 549 | 631 | 20 |
| 36 | YBR051W | 741 | 760 | 696 | 549 | 456 | 20 |
| 38 | YER175C | 749 | 757 | 627 | 610 | 140 | 16 |
| 44 | YER123W | 767 | 757 | 780 | 610 | 147 | 16 |
| 48 | YEL052W | 750 | 736 | 773 | 710 | 177 | 20 |
| 50 | Y0R536W | 753 | 736 | 772 | 709 | 293 | 20 |
| 52 | YDR513W | 782 | 794 | 660 | 413 | 411 | 54 |
| 54 | YEL045C | 755 | 736 | 553 | 709 | 147 | 20 |
| 56 | YEL041W | 758 | 736 | 769 | 709 | 129 | 20 |
| 62 | YBR282W | 759 | 760 | 724 | 549 | 221 | 20 |
| 64 | YBR258C | 759 | 757 | 772 | 610 | 144 | 16 |
| 68 | YBR274W | 749 | 736 | 769 | 709 | 146 | 20 |
| 70 | YHR090C | 749 | 760 | 765 | 549 | 620 | 20 |
| 74 | YGR127W | 740 | 549 | 576 | 20 | | |
| 76 | YGR150C | 771 | 760 | 742 | 549 | 618 | 20 |
| 78 | YKL037W | 761 | 736 | 760 | 709 | 134 | 20 |
| 80 | YKL051W | 733 | 760 | 740 | 549 | 153 | 20 |
| 82 | YKL120W | 759 | 736 | 518 | 709 | | |
| 84 | YKL011C | 750 | 760 | 694 | 549 | 434 | 20 |

TABLE 5-continued

Drought tolerance of transgenic *Arabidopsis thaliana* expressing the various SRP encoding genes from *Saccharomyces cerevisiae* or *E. coli* after imposition of drought stress on 3 week old plants in a third experiment using several plants from one transgenic line (experiment 3). Drought tolerance is reported as photosynthetic yield measured by chlorophyll fluorescence measured at three different time point during the drought stress experiment, and compared to the untransformed wild type control. For each transgenic line, the average of 5 replicate plants is indicated, the wild type value is the average of 20-25 plants measured in the same experiment.

| Sequ. ID No. | Gene | Photosynthetic yield 6 days after final watering | wild type | Photosynthetic yield 10 days after final watering | wild type | Photosynthetic yield 14 days after final watering | wild type |
|---|---|---|---|---|---|---|---|
| 86 | YKL017C | 744 | 549 | 734 | 549 | 754 | 20 |
| 92 | YGR126W | 784 | 760 | 750 | 549 | 159 | 20 |
| 94 | YKL070W | 774 | 760 | 734 | 549 | 244 | 20 |
| 96 | YKL058W | 752 | 766 | 765 | 654 | 495 | 20 |
| 98 | YHR130C | 772 | 760 | 756 | 549 | 147 | 20 |
| 100 | YIL070C | 768 | 766 | 755 | 654 | | |
| 102 | YHR19SW | 753 | 757 | 693 | 610 | 141 | 16 |
| 104 | YIR022W | 761 | 736 | 771 | 709 | | |
| 106 | YJL172W | 756 | 766 | 758 | 654 | 293 | 20 |
| 108 | YHR113W | 749 | 760 | 754 | 549 | 142 | 20 |
| 110 | YHR175W | 768 | 766 | 758 | 654 | 465 | 106 |
| 112 | YGR212W | 777 | 766 | 748 | 654 | | |
| 114 | YJL024C | 762 | 766 | 758 | 654 | 736 | 106 |
| 116 | YGR180c | 763 | 757 | 779 | 610 | | |
| 118 | YJL179W | 744 | 760 | 606 | 549 | 310 | 20 |
| 120 | YJL001W | 748 | 757 | 519 | 610 | 135 | 16 |
| 123 | YJL208C | 685 | 549 | 49 | 20 | | |
| 124 | YJL152W | 754 | 757 | 726 | 610 | | |
| 126 | YJL131C | 750 | 757 | 758 | 610 | | |
| 128 | YJL151C | 755 | 760 | 764 | 549 | 152 | 20 |
| 130 | YLR441C | 745 | 760 | 762 | 549 | 277 | 20 |
| 132 | YLR415C | 739 | 757 | 503 | 610 | 144 | 16 |
| 134 | YLR212C | 740 | 736 | 759 | 709 | 103 | 20 |
| 136 | YLR029C | 746 | 736 | 780 | 709 | 292 | 20 |
| 139 | YLR105C | 751 | 736 | 764 | 709 | | |
| 141 | YIL136W | 749 | 736 | 779 | 710 | 422 | 20 |
| 143 | YLR215C | 752 | 736 | 774 | 709 | 151 | 20 |
| 145 | YLR321C | 749 | 736 | 767 | 709 | 145 | 20 |
| 147 | YMR260C | 774 | 766 | 763 | 654 | 691 | 106 |
| 149 | YNL120C | 764 | 766 | 740 | 654 | 298 | 20 |
| 151 | YLR407W | 774 | 766 | 640 | 654 | 138 | 106 |

TABLE 5-continued

Drought tolerance of transgenic *Arabidopsis thaliana* expressing the various SRP encoding genes from *Saccharomyces cerevisiae* or *E. coli* after imposition of drought stress on 3 week old plants in a third experiment using several plants from one transgenic line (experiment 3). Drought tolerance is reported as photosynthetic yield measured by chlorophyll fluorescence measured at three different time point during the drought stress experiment, and compared to the untransformed wild type control. For each transgenic line, the average of 5 replicate plants is indicated, the wild type value is the average of 20-25 plants measured in the same experiment.

| Sequ. ID No. | Gene | Photosynthetic yield 6 days after final watering | wild type | Photosynthetic yield 10 days after final watering | wild type | Photosynthetic yield 14 days after final watering | wild type |
| --- | --- | --- | --- | --- | --- | --- | --- |
| 153 | YMR197C | 751 | 736 | 723 | 709 | 63 | 20 |
| 155 | YMR100W | 770 | 766 | 596 | 654 | 171 | 20 |
| 157 | YMR210W | 753 | 766 | 755 | 654 | 733 | 20 |
| 159 | YMR318C | 761 | 736 | 780 | 709 | 135 | 20 |
| 161 | YMR069W | 756 | 766 | 750 | 654 | 519 | 20 |
| 163 | YNL076W | 765 | 766 | 757 | 654 | 244 | 20 |
| 165 | YNL024C | 767 | 766 | 761 | 654 | 279 | 20 |
| 167 | YNL125C | 761 | 766 | 750 | 654 | 283 | 20 |
| 169 | YNL029C | 764 | 766 | 758 | 654 | | |
| 171 | YMR115W | 755 | 736 | 739 | 709 | | |
| 173 | YNL244C | 774 | 766 | 696 | 654 | 94 | 20 |
| 175 | YNL334C | 751 | 736 | 756 | 709 | | |
| 177 | YNR018W | 756 | 736 | 749 | 709 | | |
| 181 | YOL118C | 727 | 736 | 756 | 709 | 280 | 20 |
| 183 | YOL123W | 747 | 736 | | | 140 | 20 |
| 185 | YOR020C | 764 | 766 | 748 | 654 | 207 | 20 |
| 187 | YOL116W | 774 | 766 | 735 | 654 | 135 | 20 |
| 189 | YOR305w | 773 | 769 | 565 | 245 | | |
| 191 | YPL267W | 757 | 767 | 756 | 548 | | |
| 193 | YPL229w | 781 | 769 | 752 | 245 | | |
| 197 | YPR047W | 761 | 769 | 597 | 245 | | |
| 199 | YPL011C | 766 | 769 | 582 | 245 | | |
| 201 | YPR148C | 771 | 769 | 401 | 245 | | |
| 203 | YOL103W | 789 | 769 | 237 | 245 | | |
| 205 | YOR016C | 770 | 769 | 523 | 245 | | |
| 211 | YOR360C | 771 | 769 | 651 | 245 | | |
| 215 | YDL005C | 782 | 769 | 702 | 245 | | |
| 217 | YPL210C | 794 | 769 | 735 | 245 | | |
| 219 | YMR118C | 777 | 768 | 499 | 272 | | |
| 221 | YPR052C | 772 | 768 | 298 | 272 | | |
| 223 | YLR224W | 767 | 768 | 434 | 272 | | |
| 225 | YLR275W | 741 | 768 | 780 | 272 | | |

TABLE 5-continued

Drought tolerance of transgenic *Arabidopsis thaliana* expressing the various SRP encoding genes from *Saccharomyces cerevisiae* or *E. coli* after imposition of drought stress on 3 week old plants in a third experiment using several plants from one transgenic line (experiment 3). Drought tolerance is reported as photosynthetic yield measured by chlorophyll fluorescence measured at three different time point during the drought stress experiment, and compared to the untransformed wild type control. For each transgenic line, the average of 5 replicate plants is indicated, the wild type value is the average of 20-25 plants measured in the same experiment.

| Sequ. ID No. | Gene | Photosynthetic yield 6 days after final watering | wild type | Photosynthetic yield 10 days after final watering | wild type | Photosynthetic yield 14 days after final watering | wild type |
|---|---|---|---|---|---|---|---|
| 227 | YMR154G | 760 | 768 | 734 | 272 | | |
| 229 | YDR205w | 787 | 768 | 241 | 272 | | |
| 231 | YPR037C | 759 | 768 | 740 | 272 | | |
| 233 | YNR008W | 746 | 768 | 782 | 272 | | |
| 235 | YOR084W | 758 | 768 | 765 | 272 | | |
| 237 | YGR054W | 766 | 768 | 140 | 272 | | |
| 239 | YGL106W | 760 | 768 | 477 | 272 | | |
| 241 | YAL067C | 759 | 768 | 681 | 272 | | |
| 243 | YIL023c | 769 | | 814 | | | |
| 245 | YBR064W | 745 | 750 | 770 | 576 | 117 | 31 |
| 249 | b2148 | 736 | 768 | 740 | 272 | | |
| 251 | b2796 | 761 | 768 | 319 | 272 | | |
| 253 | b2082 | 756 | 768 | 706 | 272 | | |
| 255 | b0124 | 756 | 768 | 571 | 272 | | |
| 257 | b3116 | 765 | 768 | 600 | 272 | | |
| 259 | b1830 | 757 | 768 | 772 | 272 | | |
| 261 | b1453 | 750 | 768 | 648 | 272 | | |
| 263 | b2664 | 764 | 768 | 521 | 272 | | |
| 265 | b2799 | 763 | 768 | 615 | 272 | | |
| 267 | b3327 | 766 | 768 | 499 | 272 | | |
| 269 | b0970 | 764 | 768 | 560 | 272 | | |
| 271 | YER003C | 758 | 760 | 769 | 549 | 729 | 20 |
| 273 | YCL027W | 749 | 760 | 770 | 549 | 145 | 20 |
| 275 | YBR112C | 760 | 760 | 760 | 549 | 731 | 20 |
| 277 | YNL079C | 763 | 766 | 762 | 654 | 216 | 20 |
| 279 | YFR042W | 789 | 760 | 739 | 549 | 232 | 20 |
| 281 | YER137C | 760 | 760 | 728 | 549 | 458 | 20 |
| 283 | YKL103C | 747 | 760 | 763 | 549 | 791 | 20 |
| 285 | YNL090W | 757 | 760 | 783 | 549 | 403 | 20 |
| 287 | YGR161C | 742 | 760 | 753 | 549 | 225 | 20 |
| 289 | YDR071C | 737 | 757 | 793 | 610 | 707 | 16 |

Metabolic Analysis of Transgenic Plants

The described metabolic changes in transgenic plants were identified using the following experimental procedure:

a) Growth and Treatment of Plants

Plants were grown in climate chambers under standard conditions on pot soil for three weeks (see above). Eight days prior to harvest, water was withheld for part of the plants (8-day treatment). Four days prior to harvest, water was withheld for another group of plants (4-day treatment). The plants of "control treatment" were normally watered throughout the growth period. Plants due to be analysed in the same analytical sequence were grown side-by-side to avoid environmental influences.

b) Sampling and Storage of Samples

Sampling took place in the climate chamber. Green parts were cut with a pair of scissors, quickly weighed, and immediately put into a liquid nitrogen pre-cooled extraction thimble. Racks with extraction thimbles were stored at $-80°$ C. until extraction.

c) Freeze-Drying

Plants were not allowed to thaw or reach temperatures >$-40°$ C. until either the first contact with solvents or the removal of water by freeze-drying.

The sample rack with extraction thimbles was put into the pre-cooled ($-40°$ C.) freeze-dryer. The starting temperature for the main drying phase was $-35°$ C., pressure was 0.120 mbar. For the drying process, parameters were changed according to a pressure and temperature program. The final temperature (after 12 hours) was $+30°$ C., pressure was 0.001-0.004 mbar. After shutting down the vacuum pump and cooling machine, the system was aired with dried air or Argon.

d) Extraction

Extraction thimbles with plant material were transferred to 5 mL extraction cells on the ASE (Accelerated Solvent Extractor ASE 200 with Solvent Controller and AutoASE-Software (DIONEX)) immediately after freeze-drying.

Polar substances were extracted with approximately 10 mL Methanol/Water (80/20, v/v) at T=70° C. und p=140 bar, 5 min heating phase, 1 min static Extraction. Lipid substances were extracted with approximately 10 mL Methanol/Dichlormethan (40/60, v/v) at T=70° C. und p=140 bar, 5 min heating phase, 1 min static Extraction. Both extracts were collected in one extraction vial (Centrifuge tubes, 50 mL with screw-on lid and Septum for ASE (DIONEX)).

The following internal standards were added to the extracts: LC-Standards L-Methionine-d3, Boc-Ala-Gly-Gly-Gly-OH, L-Tryptophan-d5, Arginine$^{13}$C$_6$ $^{15}$N$_4$, CoEnzyme Q1,2,4 and ribitol, L-glycine-2,2-d2, L-alanine-2,3,3,3-d4, alpha-methyl-glucopyranoside, nonadecanoic acid methyl ester, undecanoic acid methyl ester, tridecanoic acid, pentadecanoic acid, nonacosanoic acid. To the resulting mixture, 8 mL water were added. The solid residues of plant and extraction thimble were discarded.

The extract was centrifuged at 1400 g for 5-10 minutes to speed-up phase-separation. For GC and LC analysis, 1 mL each was taken from the colourless methanol/water upper (polar) phase. The remaining upper phase was discarded. Of the dark-green, organic bottom phase 0.5 mL was taken for GC and LC analysis, respectively. All sample aliquots were evaporated using a IR-Dancer Infrared vacuum evaporator (Hettich), using a temperature maximum of 40° C. and a maximum pressure of 10 mbar.

e) LC/MS- and LC/MS/MS-Analysis

HPLC mobile phase was added to the lipid and polar residues, respectively (volume adjusted to the weighted sample) and an HPLC analysis using gradient elution was performed.

f) Derivatisation of the Lipid Phase for GC/MS-Analysis

For transmethanolysis, a mixture of 140 µl chloroform, 38 µL HCl (37% HCl in water), 320 µl methanol and 20 µl toluol was added to the residue. The sample container was carefully closed and reaction was carried out at 100° C. for 2 hours. Subsequently, the solution was evaporated and the pellet was dried completely.

The methoximation of carbonyl groups was achieved by a reaction with 100 µL methoxyamine-hydrochloride (5 mg/mL in Pyridine) for 1.5 hours at 60° C., in a closed vial. 20 µL of a mixture of linear, odd-numbered fatty acids was added to provide a time standard. Finally, derivatisation with 100 µL N-Methyl-N-(trimethylsilyl)-2,2,2-trifluoracetamide (MSTFA) took place in a closed vial for 30 minutes at 60° C. The final volume for GC injection was 220 µl.

g) Derivatisation of the Polar Phase for GC/MS-Analysis

The methoximation of carbonyl groups was achieved by a reaction with 50 µL methoxyamine-hydrochloride (5 mg/mL in Pyridine) for 1.5 hours at 60° C., in a closed vial. 10 µL of a mixture of linear, odd-numbered fatty acids was added to provide a time standard. Finally, derivatisation with 50 µL N-methyl-N-(trimethylsilyl)-2,2,2-trifluoracetamide (MSTFA) took place in a closed vial for 30 minutes at 60° C. The final volume for GC injection was 110 µl.

h) Analysis of Different Plant Samples

Samples were measured in sequences of 20. Each sequence contained 5 wild type and 5 transgenic plants grown under control conditions, as well as 5 wild type and 5 transgenic plants from either the 4 day or 8 day drought treatment.

The peak height or peak area of each analyte (metabolite) was divided through the peak area of the respective internal standards. Data was normalised using the individual sample fresh weight. The resulting values were divided by the mean values found for wild type plants grown under control conditions and analysed in the same sequence, resulting in the so-called X-folds or ratios (see table 7-14), which represent values independent of the analytical sequence. These ratios indicate the behavior of the metabolite concentration of the target plants in comparison to the concentration in the wild type control plants.

In table 6 the results of the metabolite screening for the plants transformed in genes YCL027W, YBR112C, YNL079C, YER137C, YKL103C, YNL090W, YGR161C, YDR071C are shown.

TABLES 6

Details on screening of metabolic activity.

| | wild type | | | YDR071C | | |
|---|---|---|---|---|---|---|
| metabolite | control | 4 days | 8 days | control | 4 days | 8 days |
| 2,3-dimethyl-5-phytylquinol | 1.00 | 0.50 | 0.54 | | | |
| 2-hydroxy-palmitic acid | 1.00 | 1.11 | 1.25 | 1.18 | | |

TABLES 6-continued

Details on screening of metabolic activity.

| metabolite | wild type | | | YDR071C | | |
| --- | --- | --- | --- | --- | --- | --- |
| | control | 4 days | 8 days | control | 4 days | 8 days |
| 3,4-dihydroxyphenylalanine (=dopa) | 1.00 | 1.83 | 3.37 | | | |
| 3-hydroxy-palmitic acid | 1.00 | | | | | |
| 5-oxoproline | 1.00 | 1.56 | 1.81 | | | |
| alanine | 1.00 | 0.64 | 0.64 | | | |
| alpha linolenic acid (c18:3 (c9, c12, c15)) | 1.00 | 1.24 | 1.40 | | | |
| alpha-tocopherol | 1.00 | 1.05 | 1.14 | | | |
| aminoadipic acid | 1.00 | 1.73 | 1.65 | | | |
| anhydroglucose | 1.00 | 1.02 | 1.16 | | | |
| arginine | 1.00 | 0.39 | 0.33 | | | |
| aspartic acid | 1.00 | 2.72 | 2.96 | | | |
| beta-apo-8' carotenal | 1.00 | 1.21 | 1.22 | | | |
| beta-carotene | 1.00 | 1.25 | 1.26 | | | |
| beta-sitosterol | 1.00 | 1.39 | 1.51 | | | |
| beta-tocopherol | 1.00 | 0.54 | 0.60 | | | |
| palmitic acid | 1.00 | 1.07 | 1.25 | | | |
| delta-7-cis,10-cis-hexadecadienic acid (c16:2 me) | 1.00 | 1.01 | 1.04 | | | |
| hexadecatrienic acid (c16:3 me) | 1.00 | 1.19 | 1.29 | | | |
| margaric acid (c17:0 me) | 1.00 | 1.19 | 1.28 | | | |
| delta-15-cis-tetracosenic acid (c24:1 me) | 1.00 | 1.16 | 1.34 | | | |
| campesterol | 1.00 | 1.32 | 1.65 | | | |
| cerotic acid (c26:0) | 1.00 | 0.74 | 1.00 | | | |
| citrulline | 1.00 | 0.51 | 0.33 | | | |
| cryptoxanthine | 1.00 | 1.00 | 0.90 | | | |
| eicosenoic acid (20:1) | 1.00 | 0.81 | 0.81 | | | |
| ferulic acid | 1.00 | 1.37 | 1.47 | | | |
| fructose | 1.00 | 14.10 | 19.78 | | | |
| fumarate | 1.00 | 5.19 | 9.33 | | | |
| galactose | 1.00 | 1.29 | 1.42 | 0.98 | | |
| g-aminobutyric acid | 1.00 | 1.16 | 1.32 | | | |
| gamma-tocopherol | 1.00 | 0.54 | 0.60 | | | |
| gluconic acid | 1.00 | 2.24 | 3.08 | | | |
| glucose | 1.00 | 14.97 | 20.73 | | | |
| glutamine | 1.00 | 0.98 | 1.17 | | | |
| glutamic acid | 1.00 | 2.01 | 2.69 | | | |
| glycerate | 1.00 | 1.87 | 2.04 | | | |
| glycerinaldehyd | 1.00 | 1.11 | 1.12 | | | |
| glycerol | 1.00 | 1.22 | 1.29 | | | |
| glycerol-3-phosphate | 1.00 | 1.86 | 2.41 | | | |
| glycine | 1.00 | 0.25 | 0.26 | | | |
| homoserine | 1.00 | 0.61 | 0.69 | | | |
| inositol | 1.00 | 4.19 | 6.32 | | | |
| isoleucine | 1.00 | 1.28 | 1.66 | | | |
| iso-maltose | 1.00 | 2.63 | 3.02 | | | |
| isopentenyl pyrophosphate | 1.00 | 1.80 | 2.62 | | | |
| leucine | 1.00 | 1.34 | 1.74 | | | |
| lignoceric acid (c24:0) | 1.00 | 0.91 | 1.02 | | | |
| linoleic acid (c18:2 (c9, c12)) | 1.00 | 1.19 | 1.38 | | | |
| luteine | 1.00 | 1.26 | 1.33 | | | |
| malate | 1.00 | 2.91 | 3.46 | | | |
| mannose | 1.00 | 16.40 | 17.80 | | | |
| triacontanoic acid | 1.00 | 1.26 | 1.23 | | | |
| methionine | 1.00 | 1.13 | 1.12 | | | |
| methylgalactofuranoside | 1.00 | 1.24 | 1.49 | | | |
| methylgalactopyranoside | 1.00 | 1.25 | 1.36 | | | |
| ornithine | | | | | | |
| palmitic acid (c16:0) | 1.00 | 1.16 | 1.38 | | | |
| phenylalanine | 1.00 | 0.92 | 1.10 | | | |
| phosphate | 1.00 | 2.15 | 2.73 | | | |
| proline | 1.00 | 1.23 | 4.77 | | | |
| putrescine | 1.00 | | 0.39 | | | |
| pyruvate | 1.00 | 1.30 | 1.21 | | | |
| raffinose | 1.00 | 17.04 | 74.78 | | | |
| ribonic acid | 1.00 | 2.32 | 3.43 | | | |
| serine | 1.00 | 0.98 | 1.13 | | | |
| shikimate | 1.00 | 1.11 | 1.07 | | | |
| sinapine acid | 1.00 | 2.74 | 3.44 | | | |
| stearic acid (c18:0) | 1.00 | 1.18 | 1.35 | | | |
| succinate | 1.00 | 2.98 | 3.49 | | | |
| sucrose | 1.00 | 1.42 | 1.70 | | | |
| threonine | 1.00 | 1.26 | 1.68 | | | |
| tryptophane | 1.00 | 1.13 | 1.89 | | | |
| tyrosine | 1.00 | 1.56 | 2.01 | | | |

TABLES 6-continued

Details on screening of metabolic activity.

| metabolite | wild type | | | YDR071C | | |
|---|---|---|---|---|---|---|
| | control | 4 days | 8 days | control | 4 days | 8 days |
| ubichinone | 1.00 | 1.02 | 1.20 | | | |
| udp-glucose | 1.00 | 1.53 | 1.94 | | | |
| valine | 1.00 | 0.98 | 1.18 | | | |
| zeaxanthine | 1.00 | 1.27 | 1.34 | | | |

| metabolite | wild type | | | YER137C | | |
|---|---|---|---|---|---|---|
| | Control | 4 days | 8 days | Control | 4 days | 8 days |
| 2,3-dimethyl-5-phytylquinol | 1.00 | 0.50 | 0.54 | 2.15 | | 5.57 |
| 2-hydroxy-palmitic acid | 1.00 | 1.11 | 1.25 | | | |
| 3,4-dihydroxyphenylalanine (=dopa) | 1.00 | 1.83 | 3.37 | | | |
| 3-hydroxy-palmitic acid | 1.00 | | | | | |
| 5-oxoproline | 1.00 | 1.56 | 1.81 | 1.55 | | 1.73 |
| alanine | 1.00 | 0.64 | 0.64 | 1.32 | | 0.94 |
| alpha linolenic acid (c18:3 (c9, c12, c15)) | 1.00 | 1.24 | 1.40 | | | |
| alpha-tocopherol | 1.00 | 1.05 | 1.14 | | | |
| aminoadipic acid | 1.00 | 1.73 | 1.65 | | | |
| anhydroglucose | 1.00 | 1.02 | 1.16 | | 1.26 | 0.63 |
| arginine | 1.00 | 0.39 | 0.33 | | | |
| aspartic acid | 1.00 | 2.72 | 2.96 | | | |
| beta-apo-8' carotenal | 1.00 | 1.21 | 1.22 | | | |
| beta-carotene | 1.00 | 1.25 | 1.26 | | | |
| beta-sitosterol | 1.00 | 1.39 | 1.51 | 0.88 | 1.17 | 1.35 |
| beta-tocopherol | 1.00 | 0.54 | 0.60 | 2.78 | | 5.83 |
| palmitic acid | 1.00 | 1.07 | 1.25 | | | |
| delta-7-cis,10-cis-hexadecadienic acid (c16:2 me) | 1.00 | 1.01 | 1.04 | | | |
| hexadecatrienic acid (c16:3 me) | 1.00 | 1.19 | 1.29 | | | |
| margaric acid (c17:0 me) | 1.00 | 1.19 | 1.28 | | | |
| delta-15-cis-tetracosenic acid (c24:1 me) | 1.00 | 1.16 | 1.34 | | | |
| campesterol | 1.00 | 1.32 | 1.65 | | 1.10 | 1.28 |
| cerotic acid (c26:0) | 1.00 | 0.74 | 1.00 | 3.24 | 1.78 | |
| citrulline | 1.00 | 0.51 | 0.33 | | | |
| cryptoxanthine | 1.00 | 1.00 | 0.90 | | | |
| eicosenoic acid (20:1) | 1.00 | 0.81 | 0.81 | | | |
| ferulic acid | 1.00 | 1.37 | 1.47 | | | |
| fructose | 1.00 | 14.10 | 19.78 | | | |
| fumarate | 1.00 | 5.19 | 9.33 | | | |
| galactose | 1.00 | 1.29 | 1.42 | | | |
| g-aminobutyric acid | 1.00 | 1.16 | 1.32 | 4.44 | | 10.51 |
| gamma-tocopherol | 1.00 | 0.54 | 0.60 | 2.78 | | 5.83 |
| gluconic acid | 1.00 | 2.24 | 3.08 | | | |
| glucose | 1.00 | 14.97 | 20.73 | | | |
| glutamine | 1.00 | 0.98 | 1.17 | | | |
| glutamic acid | 1.00 | 2.01 | 2.69 | | | |
| glycerate | 1.00 | 1.87 | 2.04 | 1.17 | 2.32 | |
| glycerinaldehyd | 1.00 | 1.11 | 1.12 | | | |
| glycerol | 1.00 | 1.22 | 1.29 | | | |
| glycerol-3-phosphate | 1.00 | 1.86 | 2.41 | 1.12 | 1.57 | 2.05 |
| glycine | 1.00 | 0.25 | 0.26 | | | |
| homoserine | 1.00 | 0.61 | 0.69 | | | |
| inositol | 1.00 | 4.19 | 6.32 | | | |
| isoleucine | 1.00 | 1.28 | 1.66 | | | |
| iso-maltose | 1.00 | 2.63 | 3.02 | | | |
| isopentenyl pyrophosphate | 1.00 | 1.80 | 2.62 | | | |
| leucine | 1.00 | 1.34 | 1.74 | | | |
| lignoceric acid (c24:0) | 1.00 | 0.91 | 1.02 | 2.01 | 1.74 | 2.03 |
| linoleic acid (c18:2 (c9, c12)) | 1.00 | 1.19 | 1.38 | | | |
| luteine | 1.00 | 1.26 | 1.33 | | | |
| malate | 1.00 | 2.91 | 3.46 | 1.67 | 5.70 | 6.01 |
| mannose | 1.00 | 16.40 | 17.80 | | | |
| triacontanoic acid | 1.00 | 1.26 | 1.23 | | | |
| methionine | 1.00 | 1.13 | 1.12 | | | |
| methylgalactofuranoside | 1.00 | 1.24 | 1.49 | | | |
| methylgalactopyranoside | 1.00 | 1.25 | 1.36 | | | |
| ornithine | | | | | | |
| palmitic acid (c16:0) | 1.00 | 1.16 | 1.38 | | | |

-continued

| metabolite | wild type | | | YER137C | | |
|---|---|---|---|---|---|---|
| | Control | 4 days | 8 days | Control | 4 days | 8 days |
| phenylalanine | 1.00 | 0.92 | 1.10 | | | |
| phosphate | 1.00 | 2.15 | 2.73 | | | |
| proline | 1.00 | 1.23 | 4.77 | | | |
| putrescine | 1.00 | | 0.39 | | | |
| pyruvate | 1.00 | 1.30 | 1.21 | | | |
| raffinose | 1.00 | 17.04 | 74.78 | | | |
| ribonic acid | 1.00 | 2.32 | 3.43 | | | |
| serine | 1.00 | 0.98 | 1.13 | | | |
| shikimate | 1.00 | 1.11 | 1.07 | | 1.40 | 1.50 |
| sinapine acid | 1.00 | 2.74 | 3.44 | | | |
| stearic acid (c18:0) | 1.00 | 1.18 | 1.35 | | | |
| succinate | 1.00 | 2.98 | 3.49 | | | |
| sucrose | 1.00 | 1.42 | 1.70 | | | |
| threonine | 1.00 | 1.26 | 1.68 | | | |
| tryptophane | 1.00 | 1.13 | 1.89 | | | |
| tyrosine | 1.00 | 1.56 | 2.01 | | | |
| ubichinone | 1.00 | 1.02 | 1.20 | | | |
| udp-glucose | 1.00 | 1.53 | 1.94 | | | |
| valine | 1.00 | 0.98 | 1.18 | | | |
| zeaxanthine | 1.00 | 1.27 | 1.34 | | | |

| metabolite | wild type | | | YBR112C | | |
|---|---|---|---|---|---|---|
| | Control | 4 days | 8 days | Control | 4 days | 8 days |
| 2,3-dimethyl-5-phytylquinol | 1.00 | 0.50 | 0.54 | 0.63 | | |
| 2-hydroxy-palmitic acid | 1.00 | 1.11 | 1.25 | | | |
| 3,4-dihydroxyphenylalanine (=dopa) | 1.00 | 1.83 | 3.37 | | | |
| 3-hydroxy-palmitic acid | 1.00 | | | | | |
| 5-oxoproline | 1.00 | 1.56 | 1.81 | | | |
| alanine | 1.00 | 0.64 | 0.64 | | | |
| alpha linolenic acid (c18:3 (c9, c12, c15)) | 1.00 | 1.24 | 1.40 | 1.12 | | 1.42 |
| alpha-tocopherol | 1.00 | 1.05 | 1.14 | | | |
| aminoadipic acid | 1.00 | 1.73 | 1.65 | 3.90 | 12.95 | |
| anhydroglucose | 1.00 | 1.02 | 1.16 | | | |
| arginine | 1.00 | 0.39 | 0.33 | | | |
| aspartic acid | 1.00 | 2.72 | 2.96 | | | |
| beta-apo-8' carotenal | 1.00 | 1.21 | 1.22 | | | |
| beta-carotene | 1.00 | 1.25 | 1.26 | 1.35 | | |
| beta-sitosterol | 1.00 | 1.39 | 1.51 | 1.19 | | |
| beta-tocopherol | 1.00 | 0.54 | 0.60 | 0.70 | | |
| palmitic acid | 1.00 | 1.07 | 1.25 | | | |
| delta-7-cis,10-cis-hexadecadienic acid (c16:2 me) | 1.00 | 1.01 | 1.04 | | | |
| hexadecatrienic acid (c16:3 me) | 1.00 | 1.19 | 1.29 | | | |
| margaric acid (c17:0 me) | 1.00 | 1.19 | 1.28 | | | |
| delta-15-cis-tetracosenic acid (c24:1 me) | 1.00 | 1.16 | 1.34 | | | |
| campesterol | 1.00 | 1.32 | 1.65 | 1.42 | | |
| cerotic acid (c26:0) | 1.00 | 0.74 | 1.00 | | | |
| citrulline | 1.00 | 0.51 | 0.33 | | | |
| cryptoxanthine | 1.00 | 1.00 | 0.90 | | | |
| eicosenoic acid (20:1) | 1.00 | 0.81 | 0.81 | | | |
| ferulic acid | 1.00 | 1.37 | 1.47 | 1.20 | | |
| fructose | 1.00 | 14.10 | 19.78 | | | |
| fumarate | 1.00 | 5.19 | 9.33 | | | |
| galactose | 1.00 | 1.29 | 1.42 | | | |
| g-aminobutyric acid | 1.00 | 1.16 | 1.32 | | | |
| gamma-tocopherol | 1.00 | 0.54 | 0.60 | 0.70 | | |
| gluconic acid | 1.00 | 2.24 | 3.08 | | | |
| glucose | 1.00 | 14.97 | 20.73 | | | |
| glutamine | 1.00 | 0.98 | 1.17 | | | |
| glutamic acid | 1.00 | 2.01 | 2.69 | | | |
| glycerate | 1.00 | 1.87 | 2.04 | | | |
| glycerinaldehyd | 1.00 | 1.11 | 1.12 | | | |
| glycerol | 1.00 | 1.22 | 1.29 | | | |
| glycerol-3-phosphate | 1.00 | 1.86 | 2.41 | | | |
| glycine | 1.00 | 0.25 | 0.26 | | | |
| homoserine | 1.00 | 0.61 | 0.69 | | | |
| inositol | 1.00 | 4.19 | 6.32 | | | |
| isoleucine | 1.00 | 1.28 | 1.66 | | | |

-continued

|  | wild type | | | YBR112C | | |
|---|---|---|---|---|---|---|
| metabolite | Control | 4 days | 8 days | Control | 4 days | 8 days |
| iso-maltose | 1.00 | 2.63 | 3.02 | | | |
| isopentenyl pyrophosphate | 1.00 | 1.80 | 2.62 | | | |
| leucine | 1.00 | 1.34 | 1.74 | | | |
| lignoceric acid (c24:0) | 1.00 | 0.91 | 1.02 | | | |
| linoleic acid (c18:2 (c9, c12)) | 1.00 | 1.19 | 1.38 | | | |
| luteine | 1.00 | 1.26 | 1.33 | 1.17 | | |
| malate | 1.00 | 2.91 | 3.46 | | | |
| mannose | 1.00 | 16.40 | 17.80 | | | |
| triacontanoic acid | 1.00 | 1.26 | 1.23 | | | |
| methionine | 1.00 | 1.13 | 1.12 | | | |
| methylgalactofuranoside | 1.00 | 1.24 | 1.49 | | | |
| methylgalactopyranoside | 1.00 | 1.25 | 1.36 | | | |
| ornithine | | | | | | |
| palmitic acid (c16:0) | 1.00 | 1.16 | 1.38 | 1.11 | | |
| phenylalanine | 1.00 | 0.92 | 1.10 | | | |
| phosphate | 1.00 | 2.15 | 2.73 | | | |
| proline | 1.00 | 1.23 | 4.77 | | | |
| putrescine | 1.00 | | 0.39 | | | |
| pyruvate | 1.00 | 1.30 | 1.21 | | | |
| raffinose | 1.00 | 17.04 | 74.78 | | | |
| ribonic acid | 1.00 | 2.32 | 3.43 | | | |
| serine | 1.00 | 0.98 | 1.13 | | | |
| shikimate | 1.00 | 1.11 | 1.07 | | | |
| sinapine acid | 1.00 | 2.74 | 3.44 | | | |
| stearic acid (c18:0) | 1.00 | 1.18 | 1.35 | | | |
| succinate | 1.00 | 2.98 | 3.49 | | | |
| sucrose | 1.00 | 1.42 | 1.70 | | | |
| threonine | 1.00 | 1.26 | 1.68 | | | |
| tryptophane | 1.00 | 1.13 | 1.89 | | | |
| tyrosine | 1.00 | 1.56 | 2.01 | | | |
| ubichinone | 1.00 | 1.02 | 1.20 | | | |
| udp-glucose | 1.00 | 1.53 | 1.94 | | | |
| valine | 1.00 | 0.98 | 1.18 | | | |
| zeaxanthine | 1.00 | 1.27 | 1.34 | | | |

|  | wild type | | | YGR161C | | |
|---|---|---|---|---|---|---|
| metabolite | Control | 4 days | 8 days | Control | 4 days | 8 days |
| 2,3-dimethyl-5-phytylquinol | 1.00 | 0.50 | 0.54 | | | |
| 2-hydroxy-palmitic acid | 1.00 | 1.11 | 1.25 | | | |
| 3,4-dihydroxyphenylalanine (=dopa) | 1.00 | 1.83 | 3.37 | | | |
| 3-hydroxy-palmitic acid | 1.00 | | | | | |
| 5-oxoproline | 1.00 | 1.56 | 1.81 | | | |
| alanine | 1.00 | 0.64 | 0.64 | | | |
| alpha linolenic acid (c18:3 (c9, c12, c15)) | 1.00 | 1.24 | 1.40 | | | |
| alpha-tocopherol | 1.00 | 1.05 | 1.14 | | | |
| aminoadipic acid | 1.00 | 1.73 | 1.65 | | | |
| anhydroglucose | 1.00 | 1.02 | 1.16 | | | |
| arginine | 1.00 | 0.39 | 0.33 | | | |
| aspartic acid | 1.00 | 2.72 | 2.96 | | | |
| beta-apo-8' carotenal | 1.00 | 1.21 | 1.22 | | | |
| beta-carotene | 1.00 | 1.25 | 1.26 | | | |
| beta-sitosterol | 1.00 | 1.39 | 1.51 | | | |
| beta-tocopherol | 1.00 | 0.54 | 0.60 | | | |
| palmitic acid | 1.00 | 1.07 | 1.25 | | | |
| delta-7-cis,10-cis-hexadecadienic acid (c16:2 me) | 1.00 | 1.01 | 1.04 | 1.14 | | |
| hexadecatrienic acid (c16:3 me) | 1.00 | 1.19 | 1.29 | | | |
| margaric acid (c17:0 me) | 1.00 | 1.19 | 1.28 | 1.22 | | |
| delta-15-cis-tetracosenic acid (c24:1 me) | 1.00 | 1.16 | 1.34 | | | |
| campesterol | 1.00 | 1.32 | 1.65 | | | |
| cerotic acid (c26:0) | 1.00 | 0.74 | 1.00 | | | |
| citrulline | 1.00 | 0.51 | 0.33 | | | |
| cryptoxanthine | 1.00 | 1.00 | 0.90 | | | |
| eicosenoic acid (20:1) | 1.00 | 0.81 | 0.81 | | | |
| ferulic acid | 1.00 | 1.37 | 1.47 | | | |
| fructose | 1.00 | 14.10 | 19.78 | | | |
| fumarate | 1.00 | 5.19 | 9.33 | | | |
| galactose | 1.00 | 1.29 | 1.42 | 1.15 | | |

-continued

|  | wild type | | | YGR161C | | |
|---|---|---|---|---|---|---|
| metabolite | Control | 4 days | 8 days | Control | 4 days | 8 days |
| g-aminobutyric acid | 1.00 | 1.16 | 1.32 | | | |
| gamma-tocopherol | 1.00 | 0.54 | 0.60 | | | |
| gluconic acid | 1.00 | 2.24 | 3.08 | | | |
| glucose | 1.00 | 14.97 | 20.73 | | | |
| glutamine | 1.00 | 0.98 | 1.17 | | | |
| glutamic acid | 1.00 | 2.01 | 2.69 | | | |
| glycerate | 1.00 | 1.87 | 2.04 | | | |
| glycerinaldehyd | 1.00 | 1.11 | 1.12 | | | |
| glycerol | 1.00 | 1.22 | 1.29 | | | |
| glycerol-3-phosphate | 1.00 | 1.86 | 2.41 | | | |
| glycine | 1.00 | 0.25 | 0.26 | | | |
| homoserine | 1.00 | 0.61 | 0.69 | | | |
| inositol | 1.00 | 4.19 | 6.32 | | | |
| isoleucine | 1.00 | 1.28 | 1.66 | | | |
| iso-maltose | 1.00 | 2.63 | 3.02 | | | |
| isopentenyl pyrophosphate | 1.00 | 1.80 | 2.62 | | | |
| leucine | 1.00 | 1.34 | 1.74 | | | |
| lignoceric acid (c24:0) | 1.00 | 0.91 | 1.02 | | | |
| linoleic acid (c18:2 (c9, c12)) | 1.00 | 1.19 | 1.38 | | | |
| luteine | 1.00 | 1.26 | 1.33 | | | |
| malate | 1.00 | 2.91 | 3.46 | | | |
| mannose | 1.00 | 16.40 | 17.80 | | | |
| triacontanoic acid | 1.00 | 1.26 | 1.23 | | | |
| methionine | 1.00 | 1.13 | 1.12 | | | |
| methylgalactofuranoside | 1.00 | 1.24 | 1.49 | | | |
| methylgalactopyranoside | 1.00 | 1.25 | 1.36 | 1.18 | | |
| ornithine | | | | | | |
| palmitic acid (c16:0) | 1.00 | 1.16 | 1.38 | | | |
| phenylalanine | 1.00 | 0.92 | 1.10 | | | |
| phosphate | 1.00 | 2.15 | 2.73 | | | |
| proline | 1.00 | 1.23 | 4.77 | | | |
| putrescine | 1.00 | | 0.39 | | | |
| pyruvate | 1.00 | 1.30 | 1.21 | | | |
| raffinose | 1.00 | 17.04 | 74.78 | | | |
| ribonic acid | 1.00 | 2.32 | 3.43 | | | |
| serine | 1.00 | 0.98 | 1.13 | | | |
| shikimate | 1.00 | 1.11 | 1.07 | | | |
| sinapine acid | 1.00 | 2.74 | 3.44 | | | |
| stearic acid (c18:0) | 1.00 | 1.18 | 1.35 | | | |
| succinate | 1.00 | 2.98 | 3.49 | | | |
| sucrose | 1.00 | 1.42 | 1.70 | | | |
| threonine | 1.00 | 1.26 | 1.68 | | | |
| tryptophane | 1.00 | 1.13 | 1.89 | | | |
| tyrosine | 1.00 | 1.56 | 2.01 | | | |
| ubichinone | 1.00 | 1.02 | 1.20 | | | |
| udp-glucose | 1.00 | 1.53 | 1.94 | | | |
| valine | 1.00 | 0.98 | 1.18 | | | |
| zeaxanthine | 1.00 | 1.27 | 1.34 | | | |

|  | YKL103C | | | | | |
|---|---|---|---|---|---|---|
| metabolite | Control | 4 days | 8 days | Control | 4 days | 8 days |
| 2,3-dimethyl-5-phytylquinol | 1.00 | 0.50 | 0.54 | | | |
| 2-hydroxy-palmitic acid | 1.00 | 1.11 | 1.25 | | | |
| 3,4-dihydroxyphenylalanine (=dopa) | 1.00 | 1.83 | 3.37 | | | |
| 3-hydroxy-palmitic acid | 1.00 | | | | | |
| 5-oxoproline | 1.00 | 1.56 | 1.81 | | | |
| alanine | 1.00 | 0.64 | 0.64 | | | |
| alpha linolenic acid (c18:3 (c9, c12, c15)) | 1.00 | 1.24 | 1.40 | | | |
| alpha-tocopherol | 1.00 | 1.05 | 1.14 | | | |
| aminoadipic acid | 1.00 | 1.73 | 1.65 | | | |
| anhydroglucose | 1.00 | 1.02 | 1.16 | | | |
| arginine | 1.00 | 0.39 | 0.33 | | | |
| aspartic acid | 1.00 | 2.72 | 2.96 | | | |
| beta-apo-8' carotenal | 1.00 | 1.21 | 1.22 | | | |
| beta-carotene | 1.00 | 1.25 | 1.26 | | | |
| beta-sitosterol | 1.00 | 1.39 | 1.51 | | | |
| beta-tocopherol | 1.00 | 0.54 | 0.60 | | | |
| palmitic acid | 1.00 | 1.07 | 1.25 | | | |

-continued

| metabolite | YKL103C | | | | | |
|---|---|---|---|---|---|---|
| | Control | 4 days | 8 days | Control | 4 days | 8 days |
| delta-7-cis,10-cis-hexadecadienic acid (c16:2 me) | 1.00 | 1.01 | 1.04 | 1.18 | 1.16 | 1.30 |
| hexadecatrienic acid (c16:3 me) | 1.00 | 1.19 | 1.29 | | | |
| margaric acid (c17:0 me) | 1.00 | 1.19 | 1.28 | | | |
| delta-15-cis-tetracosenic acid (c24:1 me) | 1.00 | 1.16 | 1.34 | | | |
| campesterol | 1.00 | 1.32 | 1.65 | | | |
| cerotic acid (c26:0) | 1.00 | 0.74 | 1.00 | | | |
| citrulline | 1.00 | 0.51 | 0.33 | | | |
| cryptoxanthine | 1.00 | 1.00 | 0.90 | | | |
| eicosenoic acid (20:1) | 1.00 | 0.81 | 0.81 | | | |
| ferulic acid | 1.00 | 1.37 | 1.47 | | | |
| fructose | 1.00 | 14.10 | 19.78 | | | |
| fumarate | 1.00 | 5.19 | 9.33 | | | |
| galactose | 1.00 | 1.29 | 1.42 | | | |
| g-aminobutyric acid | 1.00 | 1.16 | 1.32 | | | |
| gamma-tocopherol | 1.00 | 0.54 | 0.60 | | | |
| gluconic acid | 1.00 | 2.24 | 3.08 | | | |
| glucose | 1.00 | 14.97 | 20.73 | | | |
| glutamine | 1.00 | 0.98 | 1.17 | | | |
| glutamic acid | 1.00 | 2.01 | 2.69 | | | |
| glycerate | 1.00 | 1.87 | 2.04 | | | |
| glycerinaldehyd | 1.00 | 1.11 | 1.12 | | | |
| glycerol | 1.00 | 1.22 | 1.29 | | | |
| glycerol-3-phosphate | 1.00 | 1.86 | 2.41 | | | |
| glycine | 1.00 | 0.25 | 0.26 | | | |
| homoserine | 1.00 | 0.61 | 0.69 | | | |
| inositol | 1.00 | 4.19 | 6.32 | | | |
| isoleucine | 1.00 | 1.28 | 1.66 | | | |
| iso-maltose | 1.00 | 2.63 | 3.02 | | | |
| isopentenyl pyrophosphate | 1.00 | 1.80 | 2.62 | | | |
| leucine | 1.00 | 1.34 | 1.74 | | | |
| lignoceric acid (c24:0) | 1.00 | 0.91 | 1.02 | | | |
| linoleic acid (c18:2 (c9, c12)) | 1.00 | 1.19 | 1.38 | | | |
| luteine | 1.00 | 1.26 | 1.33 | | | |
| malate | 1.00 | 2.91 | 3.46 | | | |
| mannose | 1.00 | 16.40 | 17.80 | | | |
| triacontanoic acid | 1.00 | 1.26 | 1.23 | | | |
| methionine | 1.00 | 1.13 | 1.12 | | | |
| methylgalactofuranoside | 1.00 | 1.24 | 1.49 | | | |
| methylgalactopyranoside | 1.00 | 1.25 | 1.36 | | | |
| ornithine | | | | | 1.70 | 1.52 |
| palmitic acid (c16:0) | 1.00 | 1.16 | 1.38 | | | |
| phenylalanine | 1.00 | 0.92 | 1.10 | | | |
| phosphate | 1.00 | 2.15 | 2.73 | | | |
| proline | 1.00 | 1.23 | 4.77 | | | |
| putrescine | 1.00 | | 0.39 | | | |
| pyruvate | 1.00 | 1.30 | 1.21 | | | |
| raffinose | 1.00 | 17.04 | 74.78 | | | |
| ribonic acid | 1.00 | 2.32 | 3.43 | | | |
| serine | 1.00 | 0.98 | 1.13 | | | |
| shikimate | 1.00 | 1.11 | 1.07 | | | |
| sinapine acid | 1.00 | 2.74 | 3.44 | | | |
| stearic acid (c18:0) | 1.00 | 1.18 | 1.35 | | | |
| succinate | 1.00 | 2.98 | 3.49 | | | |
| sucrose | 1.00 | 1.42 | 1.70 | | | |
| threonine | 1.00 | 1.26 | 1.68 | | | |
| tryptophane | 1.00 | 1.13 | 1.89 | | | |
| tyrosine | 1.00 | 1.56 | 2.01 | | | |
| ubichinone | 1.00 | 1.02 | 1.20 | | | |
| udp-glucose | 1.00 | 1.53 | 1.94 | | | |
| valine | 1.00 | 0.98 | 1.18 | | | |
| zeaxanthine | 1.00 | 1.27 | 1.34 | | | |

| | YCL027W | | | | | |
|---|---|---|---|---|---|---|
| metabolite | Control | 4 days | 8 days | Control | 4 days | 8 days |
| 2,3-dimethyl-5-phytylquinol | 1.00 | 0.50 | 0.54 | | | |
| 2-hydroxy-palmitic acid | 1.00 | 1.11 | 1.25 | | | |
| 3,4-dihydroxyphenylalanine (=dopa) | 1.00 | 1.83 | 3.37 | | | |
| 3-hydroxy-palmitic acid | 1.00 | | | | | |
| 5-oxoproline | 1.00 | 1.56 | 1.81 | | | |
| alanine | 1.00 | 0.64 | 0.64 | | | |
| alpha linolenic acid (c18:3 (c9, c12, c15)) | 1.00 | 1.24 | 1.40 | | | |
| alpha-tocopherol | 1.00 | 1.05 | 1.14 | | | |
| aminoadipic acid | 1.00 | 1.73 | 1.65 | | | |
| anhydroglucose | 1.00 | 1.02 | 1.16 | | | |
| arginine | 1.00 | 0.39 | 0.33 | | | |
| aspartic acid | 1.00 | 2.72 | 2.96 | | | |
| beta-apo-8' carotenal | 1.00 | 1.21 | 1.22 | | | |
| beta-carotene | 1.00 | 1.25 | 1.26 | | | |
| beta-sitosterol | 1.00 | 1.39 | 1.51 | | | |
| beta-tocopherol | 1.00 | 0.54 | 0.60 | | | |
| palmitic acid | 1.00 | 1.07 | 1.25 | | | |
| delta-7-cis,10-cis-hexadecadienic acid (c16:2 me) | 1.00 | 1.01 | 1.04 | | | |
| hexadecatrienic acid (c16:3 me) | 1.00 | 1.19 | 1.29 | | | |
| margaric acid (c17:0 me) | 1.00 | 1.19 | 1.28 | | | |
| delta-15-cis-tetracosenic acid (c24:1 me) | 1.00 | 1.16 | 1.34 | | | |
| campesterol | 1.00 | 1.32 | 1.65 | | | |
| cerotic acid (c26:0) | 1.00 | 0.74 | 1.00 | | | |
| citrulline | 1.00 | 0.51 | 0.33 | | | |
| cryptoxanthine | 1.00 | 1.00 | 0.90 | | | |
| eicosenoic acid (20:1) | 1.00 | 0.81 | 0.81 | | | |
| ferulic acid | 1.00 | 1.37 | 1.47 | 0.79 | 0.74 | 0.80 |
| fructose | 1.00 | 14.10 | 19.78 | | | |
| fumarate | 1.00 | 5.19 | 9.33 | | | |
| galactose | 1.00 | 1.29 | 1.42 | | | |
| g-aminobutyric acid | 1.00 | 1.16 | 1.32 | | | |
| gamma-tocopherol | 1.00 | 0.54 | 0.60 | | | |
| gluconic acid | 1.00 | 2.24 | 3.08 | | | |
| glucose | 1.00 | 14.97 | 20.73 | | | |
| glutamine | 1.00 | 0.98 | 1.17 | | | |
| glutamic acid | 1.00 | 2.01 | 2.69 | | | |
| glycerate | 1.00 | 1.87 | 2.04 | | | |
| glycerinaldehyd | 1.00 | 1.11 | 1.12 | | | |
| glycerol | 1.00 | 1.22 | 1.29 | | | |
| glycerol-3-phosphate | 1.00 | 1.86 | 2.41 | | | |
| glycine | 1.00 | 0.25 | 0.26 | | | |
| homoserine | 1.00 | 0.61 | 0.69 | | | |
| inositol | 1.00 | 4.19 | 6.32 | | | |
| isoleucine | 1.00 | 1.28 | 1.66 | | | |
| iso-maltose | 1.00 | 2.63 | 3.02 | | | |
| isopentenyl pyrophosphate | 1.00 | 1.80 | 2.62 | | | |
| leucine | 1.00 | 1.34 | 1.74 | | | |
| lignoceric acid (c24:0) | 1.00 | 0.91 | 1.02 | | | |
| linoleic acid (c18:2 (c9, c12)) | 1.00 | 1.19 | 1.38 | | | |
| luteine | 1.00 | 1.26 | 1.33 | | | |
| malate | 1.00 | 2.91 | 3.46 | | | |
| mannose | 1.00 | 16.40 | 17.80 | | | |
| triacontanoic acid | 1.00 | 1.26 | 1.23 | | | |
| methionine | 1.00 | 1.13 | 1.12 | | | |
| methylgalactofuranoside | 1.00 | 1.24 | 1.49 | | | |
| methylgalactopyranoside | 1.00 | 1.25 | 1.36 | | | |
| ornithine | | | | | | |
| palmitic acid (c16:0) | 1.00 | 1.16 | 1.38 | | | |
| phenylalanine | 1.00 | 0.92 | 1.10 | | | |
| phosphate | 1.00 | 2.15 | 2.73 | | | |
| proline | 1.00 | 1.23 | 4.77 | | | |
| putrescine | 1.00 | | 0.39 | | | |
| pyruvate | 1.00 | 1.30 | 1.21 | | | |
| raffinose | 1.00 | 17.04 | 74.78 | | | |
| ribonic acid | 1.00 | 2.32 | 3.43 | | | |
| serine | 1.00 | 0.98 | 1.13 | | | |
| shikimate | 1.00 | 1.11 | 1.07 | | | |
| sinapine acid | 1.00 | 2.74 | 3.44 | | | |
| stearic acid (c18:0) | 1.00 | 1.18 | 1.35 | | | |
| succinate | 1.00 | 2.98 | 3.49 | | | |
| sucrose | 1.00 | 1.42 | 1.70 | | | |
| threonine | 1.00 | 1.26 | 1.68 | | | |
| tryptophane | 1.00 | 1.13 | 1.89 | | | |
| tyrosine | 1.00 | 1.56 | 2.01 | | | |

-continued

| | YCL027W | | | | | |
|---|---|---|---|---|---|---|
| metabolite | Control | 4 days | 8 days | Control | 4 days | 8 days |
| ubichinone | 1.00 | 1.02 | 1.20 | | | |
| udp-glucose | 1.00 | 1.53 | 1.94 | | | |
| valine | 1.00 | 0.98 | 1.18 | | | |
| zeaxanthine | 1.00 | 1.27 | 1.34 | | | |

| | YNL079C | | | | | |
|---|---|---|---|---|---|---|
| metabolite | Control | 4 days | 8 days | Control | 4 days | 8 days |
| 2,3-dimethyl-5-phytylquinol | 1.00 | 0.50 | 0.54 | 0.59 | | |
| 2-hydroxy-palmitic acid | 1.00 | 1.11 | 1.25 | | | |
| 3,4-dihydroxyphenylalanine (=dopa) | 1.00 | 1.83 | 3.37 | | | |
| 3-hydroxy-palmitic acid | 1.00 | | ! | | | |
| 5-oxoproline | 1.00 | 1.56 | 1.81 | | | |
| alanine | 1.00 | 0.64 | 0.64 | | | |
| alpha linolenic acid (c18:3 (c9, c12, c15)) | 1.00 | 1.24 | 1.40 | | 1.53 | 1.56 |
| alpha-tocopherol | 1.00 | 1.05 | 1.14 | | 2.64 | 3.66 |
| aminoadipic acid | 1.00 | 1.73 | 1.65 | | | |
| anhydroglucose | 1.00 | 1.02 | 1.16 | | | |
| arginine | 1.00 | 0.39 | 0.33 | | | |
| aspartic acid | 1.00 | 2.72 | 2.96 | | | |
| beta-apo-8' carotenal | 1.00 | 1.21 | 1.22 | | | |
| beta-carotene | 1.00 | 1.25 | 1.26 | | 1.26 | 1.20 |
| beta-sitosterol | 1.00 | 1.39 | 1.51 | | | |
| beta-tocopherol | 1.00 | 0.54 | 0.60 | 0.73 | | 0.56 |
| palmitic acid | 1.00 | 1.07 | 1.25 | | | |
| delta-7-cis,10-cis-hexadecadienic acid (c16:2 me) | 1.00 | 1.01 | 1.04 | | | |
| hexadecatrienic acid (c16:3 me) | 1.00 | 1.19 | 1.29 | | | |
| margaric acid (c17:0 me) | 1.00 | 1.19 | 1.28 | 1.22 | 1.53 | 1.36 |
| delta-15-cis-tetracosenic acid (c24:1 me) | 1.00 | 1.16 | 1.34 | | | |
| campesterol | 1.00 | 1.32 | 1.65 | | 1.79 | 1.82 |
| cerotic acid (c26:0) | 1.00 | 0.74 | 1.00 | | | |
| citrulline | 1.00 | 0.51 | 0.33 | | | |
| cryptoxanthine | 1.00 | 1.00 | 0.90 | | | |
| eicosenoic acid (20:1) | 1.00 | 0.81 | 0.81 | | | |
| ferulic acid | 1.00 | 1.37 | 1.47 | | | |
| fructose | 1.00 | 14.10 | 19.78 | | | |
| fumarate | 1.00 | 5.19 | 9.33 | | | |
| galactose | 1.00 | 1.29 | 1.42 | | | |
| g-aminobutyric acid | 1.00 | 1.16 | 1.32 | | | |
| gamma-tocopherol | 1.00 | 0.54 | 0.60 | | | |
| gluconic acid | 1.00 | 2.24 | 3.08 | | | |
| glucose | 1.00 | 14.97 | 20.73 | | | |
| glutamine | 1.00 | 0.98 | 1.17 | | | |
| glutamic acid | 1.00 | 2.01 | 2.69 | | | |
| glycerate | 1.00 | 1.87 | 2.04 | | | |
| glycerinaldehyd | 1.00 | 1.11 | 1.12 | | | |
| glycerol | 1.00 | 1.22 | 1.29 | | | |
| glycerol-3-phosphate | 1.00 | 1.86 | 2.41 | | | |
| glycine | 1.00 | 0.25 | 0.26 | | | |
| homoserine | 1.00 | 0.61 | 0.69 | | | |
| inositol | 1.00 | 4.19 | 6.32 | | 4.73 | 6.12 |
| isoleucine | 1.00 | 1.28 | 1.66 | | | |
| iso-maltose | 1.00 | 2.63 | 3.02 | | 4.42 | 4.93 |
| isopentenyl pyrophosphate | 1.00 | 1.80 | 2.62 | | | |
| leucine | 1.00 | 1.34 | 1.74 | | 1.51 | 2.19 |
| lignoceric acid (c24:0) | 1.00 | 0.91 | 1.02 | | | |
| linoleic acid (c18:2 (c9, c12)) | 1.00 | 1.19 | 1.38 | | | |
| luteine | 1.00 | 1.26 | 1.33 | | | |
| malate | 1.00 | 2.91 | 3.46 | 1.49 | | 5.72 |
| mannose | 1.00 | 16.40 | 17.80 | | | |
| triacontanoic acid | 1.00 | 1.26 | 1.23 | | | |
| methionine | 1.00 | 1.13 | 1.12 | | | |
| methylgalactofuranoside | 1.00 | 1.24 | 1.49 | | | |
| methylgalactopyranoside | 1.00 | 1.25 | 1.36 | | | |
| ornithine | | | | | | |
| palmitic acid (c16:0) | 1.00 | 1.16 | 1.38 | | | |
| phenylalanine | 1.00 | 0.92 | 1.10 | | | |
| phosphate | 1.00 | 2.15 | 2.73 | | | |

-continued

| | YNL079C | | | | | |
|---|---|---|---|---|---|---|
| metabolite | Control | 4 days | 8 days | Control | 4 days | 8 days |
| proline | 1.00 | 1.23 | 4.77 | | | |
| putrescine | 1.00 | | 0.39 | | | |
| pyruvate | 1.00 | 1.30 | 1.21 | | | |
| raffinose | 1.00 | 17.04 | 74.78 | | | |
| ribonic acid | 1.00 | 2.32 | 3.43 | | | |
| serine | 1.00 | 0.98 | 1.13 | | | |
| shikimate | 1.00 | 1.11 | 1.07 | | | |
| sinapine acid | 1.00 | 2.74 | 3.44 | | 3.89 | 2.79 |
| stearic acid (c18:0) | 1.00 | 1.18 | 1.35 | | | |
| succinate | 1.00 | 2.98 | 3.49 | | | |
| sucrose | 1.00 | 1.42 | 1.70 | | | |
| threonine | 1.00 | 1.26 | 1.68 | | | |
| tryptophane | 1.00 | 1.13 | 1.89 | | 2.68 | 2.98 |
| tyrosine | 1.00 | 1.56 | 2.01 | | | |
| ubichinone | 1.00 | 1.02 | 1.20 | | 0.88 | 1.02 |
| udp-glucose | 1.00 | 1.53 | 1.94 | | | |
| valine | 1.00 | 0.98 | 1.18 | | | |
| zeaxanthine | 1.00 | 1.27 | 1.34 | | | |

| | wild type | | | YNL090W | | |
|---|---|---|---|---|---|---|
| metabolite | Control | 4 days | 8 days | Control | 4 days | 8 days |
| 2,3-dimethyl-5-phytylquinol | 1.00 | 0.50 | 0.54 | | | |
| 2-hydroxy-palmitic acid | 1.00 | 1.11 | 1.25 | 1.15 | 1.25 | |
| 3,4-dihydroxyphenylalanine (=dopa) | 1.00 | 1.83 | 3.37 | | | |
| 3-hydroxy-palmitic acid | 1.00 | | | | | |
| 5-oxoproline | 1.00 | 1.56 | 1.81 | | | |
| alanine | 1.00 | 0.64 | 0.64 | | | |
| alpha linolenic acid (c18:3 (c9, c12, c15)) | 1.00 | 1.24 | 1.40 | | | |
| alpha-tocopherol | 1.00 | 1.05 | 1.14 | 1.30 | | 5.28 |
| aminoadipic acid | 1.00 | 1.73 | 1.65 | | | |
| anhydroglucose | 1.00 | 1.02 | 1.16 | | | |
| arginine | 1.00 | 0.39 | 0.33 | | 0.85 | |
| aspartic acid | 1.00 | 2.72 | 2.96 | | | |
| beta-apo-8' carotenal | 1.00 | 1.21 | 1.22 | | | |
| beta-carotene | 1.00 | 1.25 | 1.26 | 1.15 | | 1.91 |
| beta-sitosterol | 1.00 | 1.39 | 1.51 | | | |
| beta-tocopherol | 1.00 | 0.54 | 0.60 | | | |
| palmitic acid | 1.00 | 1.07 | 1.25 | | | |
| delta-7-cis,10-cis-hexadecadienic acid (c16:2 me) | 1.00 | 1.01 | 1.04 | | | |
| hexadecatrienic acid (c16:3 me) | 1.00 | 1.19 | 1.29 | | | |
| margaric acid (c17:0 me) | 1.00 | 1.19 | 1.28 | | | |
| delta-15-cis-tetracosenic acid (c24:1 me) | 1.00 | 1.16 | 1.34 | | | |
| campesterol | 1.00 | 1.32 | 1.65 | | | |
| cerotic acid (c26:0) | 1.00 | 0.74 | 1.00 | 2.98 | 3.93 | |
| citrulline | 1.00 | 0.51 | 0.33 | | | |
| cryptoxanthine | 1.00 | 1.00 | 0.90 | | | |
| eicosenoic acid (20:1) | 1.00 | 0.81 | 0.81 | | | |
| ferulic acid | 1.00 | 1.37 | 1.47 | | | |
| fructose | 1.00 | 14.10 | 19.78 | | | |
| fumarate | 1.00 | 5.19 | 9.33 | 0.76 | | |
| galactose | 1.00 | 1.29 | 1.42 | | | |
| g-aminobutyric acid | 1.00 | 1.16 | 1.32 | | | |
| gamma-tocopherol | 1.00 | 0.54 | 0.60 | | | 1.69 |
| gluconic acid | 1.00 | 2.24 | 3.08 | | | |
| glucose | 1.00 | 14.97 | 20.73 | | | |
| glutamine | 1.00 | 0.98 | 1.17 | | | |
| glutamic acid | 1.00 | 2.01 | 2.69 | | | |
| glycerate | 1.00 | 1.87 | 2.04 | | | |
| glycerinaldehyd | 1.00 | 1.11 | 1.12 | | | |
| glycerol | 1.00 | 1.22 | 1.29 | | | |
| glycerol-3-phosphate | 1.00 | 1.86 | 2.41 | | | |
| glycine | 1.00 | 0.25 | 0.26 | | | |
| homoserine | 1.00 | 0.61 | 0.69 | | | |
| inositol | 1.00 | 4.19 | 6.32 | 1.46 | | 9.70 |
| isoleucine | 1.00 | 1.28 | 1.66 | | 3.54 | 4.86 |
| iso-maltose | 1.00 | 2.63 | 3.02 | 3.59 | 20.72 | 14.65 |
| isopentenyl pyrophosphate | 1.00 | 1.80 | 2.62 | 1.79 | | |

-continued

| | wild type | | | YNL090W | | |
|---|---|---|---|---|---|---|
| metabolite | Control | 4 days | 8 days | Control | 4 days | 8 days |
| leucine | 1.00 | 1.34 | 1.74 | | | |
| lignoceric acid (c24:0) | 1.00 | 0.91 | 1.02 | | | |
| linoleic acid (c18:2 (c9, c12)) | 1.00 | 1.19 | 1.38 | | | |
| luteine | 1.00 | 1.26 | 1.33 | | | |
| malate | 1.00 | 2.91 | 3.46 | 2.12 | | 14.49 |
| mannose | 1.00 | 16.40 | 17.80 | | | |
| triacontanoic acid | 1.00 | 1.26 | 1.23 | | | |
| methionine | 1.00 | 1.13 | 1.12 | | | |
| methylgalactofuranoside | 1.00 | 1.24 | 1.49 | | | |
| methylgalactopyranoside | 1.00 | 1.25 | 1.36 | | | |
| ornithine | | | | | | |
| palmitic acid (c16:0) | 1.00 | 1.16 | 1.38 | | | |
| phenylalanine | 1.00 | 0.92 | 1.10 | | | |
| phosphate | 1.00 | 2.15 | 2.73 | | | |
| proline | 1.00 | 1.23 | 4.77 | | | |
| putrescine | 1.00 | | 0.39 | | | |
| pyruvate | 1.00 | 1.30 | 1.21 | | | |
| raffinose | 1.00 | 17.04 | 74.78 | | | |
| ribonic acid | 1.00 | 2.32 | 3.43 | | | |
| serine | 1.00 | 0.98 | 1.13 | | | |
| shikimate | 1.00 | 1.11 | 1.07 | | | |
| sinapine acid | 1.00 | 2.74 | 3.44 | | | |
| stearic acid (c18:0) | 1.00 | 1.18 | 1.35 | | | |
| succinate | 1.00 | 2.98 | 3.49 | | | |
| sucrose | 1.00 | 1.42 | 1.70 | | | |
| threonine | 1.00 | 1.26 | 1.68 | | | |
| tryptophane | 1.00 | 1.13 | 1.89 | | | |
| tyrosine | 1.00 | 1.56 | 2.01 | | | |
| ubichinone | 1.00 | 1.02 | 1.20 | | | |
| udp-glucose | 1.00 | 1.53 | 1.94 | | | |
| valine | 1.00 | 0.98 | 1.18 | 1.13 | 1.55 | 1.80 |
| zeaxanthine | 1.00 | 1.27 | 1.34 | | | |

EXAMPLE 2

Engineering Stress-Tolerant *Arabidopsis* Plants by Over-Expressing Stress Related Protein Encoding Genes from *Saccharomyces cereviesae* or *E. coli* or *Brassica napus, Glycine max*, and *Oryza sativa* using Stress-Inducible and Tissue-Specific Promoters.

Transgenic *Arabidopsis* plants were created as in example 1 to express the stress related protein encoding transgenes under the control of either a tissue-specific or stress-inducible promoter. Constitutive expression of a transgene may cause deleterious side effects. Stress inducible expression was achieved using promoters selected from those listed above in Table 1.

T2 generation plants were produced and treated with drought stress in two experiments. For the first drought experiment, the plants were deprived of water until the plant and soil were desiccated. At various times after withholding water, a normal watering schedule was resumed and the plants were grown to maturity. Seed yield was determined as seeds per plant. At an equivalent degree of drought stress, tolerant plants were able to resume normal growth and produced more seeds than non-transgenic control plants. Proline content of the leaves and stomatal aperture were also measured at various times during the drought stress. Tolerant plants maintained a lower proline content and a greater stomatal aperture than the non-transgenic control plants.

An alternative method to impose water stress on the transgenic plants was by treatment with water containing an osmolyte such as polyethylene glycol (PEG) at specific water potential. Since PEG may be toxic, the plants were given only a short term exposure and then normal watering was resumed. As above, seed yields were measured from the mature plants. The response was measured during the stress period by physical measurements, such as stomatal aperture or osmotic potential, or biochemical measurements, such as accumulation of proline. Tolerant plants had higher seed yields, maintained their stomatal aperture and showed only slight changes in osmotic potential and proline levels, whereas the susceptible non-transgenic control plants closed their stomata and exhibited increased osmotic potential and proline levels.

The transgenic plants with a constitutive promoter controlling transcription of the transgene were compared to those plants with a drought-inducible promoter in the absence of stress. The results indicated that the metabolite and gene expression changes did not occur when plants with the stress-inducible promoter were grown in the absence of stress. These plants also had higher seed yields than those with the constitutive promoter.

EXAMPLE 3

Over-Expression of Stress Related Genes from *Saccharomyces cerevisiae* or *E. coli* or *Brassica napus, Glycine max*, and *Olyza sativa* Provides Tolerance of Multiple Abiotic Stresses.

Plants that exhibit tolerance of one abiotic stress often exhibit tolerance of another environmental stress or an oxygen free radical generating herbicide. This phenomenon of cross-tolerance is not understood at a mechanistic level (McKersie and Leshem, 1994). Nonetheless, it is reasonable to expect that plants exhibiting enhanced drought tolerance due to the expression of a transgene might also exhibit tolerance of low temperatures, freezing, salt, air pollutants such as ozone, and other abiotic stresses. In support of this hypothesis, the expression of several genes are up or down-regulated by multiple abiotic stress factors including cold, salt, osmoticum, ABA, etc (e.g. Hong et al. (1992) Developmental and organ-specific expression of an ABA- and stress-induced protein in barley. Plant Mol Biol 18: 663-674; Jagendorf and Takabe (2001) Inducers of glycinebetaine synthesis in barley. Plant Physiol 127: 1827-1835); Mizoguchi et al. (1996) A gene encoding a mitogen-activated protein kinase is induced simultaneously with genes for a mitogen-activated protein kinase and an S6 ribosomal protein kinase by touch, cold, and water stress in *Arabidopsis thaliana*. Proc Natl Acad Sci USA 93: 765-769; Zhu (2001) Cell signaling under salt, water and cold stresses. Curr Opin Plant Biol 4: 401-406).

To determine salt tolerance, seeds of *Arabidopsis thaliana* were sterilized (100% bleach, 0.1% TritonX for five minutes two times and rinsed five times with ddH2O). Seeds were plated on non-selection media (½ MS, 0.6% phytagar, 0.5 g/L MES, 1% sucrose, 2 µg/ml benamyl). Seeds are allowed to germinate for approximately ten days. At the 4-5 leaf stage, transgenic plants were potted into 5.5 cm diameter pots and allowed to grow (22° C., continuous light) for approximately seven days, watering as needed. To begin the assay, two liters of 100 mM NaCl and ⅛ MS was added to the tray under the pots. To the tray containing the control plants, three liters of ⅛ MS was added. The concentrations of NaCl supplementation were increased stepwise by 50 mM every 4 days up to 200 mM. After the salt treatment with 200 mM, fresh and dry weights of the plants as well as seed yields were determined.

To determine cold tolerance, seeds of the transgenic and cold lines were germinated and grown for approximately 10 days to the 4-5 leaf stage as above. The plants were then transferred to cold temperatures (5° C.) and grown through the flowering and seed set stages of development. Photosynthesis was measured using chlorophyll fluorescence as an indicator of photosynthetic fitness and integrity of the photosystems. Seed yield and plant dry weight were measured as an indictor of plant biomass production.

Plants that had tolerance to salinity or cold had higher seed yields, photosynthesis and dry matter production than susceptible plants.

EXAMPLE 4

Engineering Stress-Tolerant Alfalfa Plants by Over-Expressing Stress Related Genes from *Saccharomyces cerevisiae* or *E. coli* or *Brassica napus, Glycine max*, and *Oryza sativa*

A regenerating clone of alfalfa (*Medicago sativa*) was transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659).

Petiole explants were cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,3666 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) was used to provide constitutive expression of the trait gene.

The explants were cocultivated for 3 d in the dark on SH induction medium containing 288 mg/L Pro, 53 mg/L thioproline, 4.35 g/L K2SO4, and 100 µm acetosyringinone. The explants were washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos were transferred to BOi2Y development medium containing no growth regulators, no antibiotics, and 50 g/L sucrose. Somatic embryos were subsequently germinated on half-strength Murashige-Skoog medium. Rooted seedlings were transplanted into pots and grown in a greenhouse.

The T0 transgenic plants were propagated by node cuttings and rooted in Turface growth medium. The plants were defoliated and grown to a height of about 10 cm (approximately 2 weeks after defoliation). The plants were then subjected to drought stress in two experiments.

For the first drought experiment, the seedlings received no water for a period up to 3 weeks at which time the plant and soil were desiccated. At various times after withholding water, a normal watering schedule was resumed. At one week after resuming watering, the fresh and dry weights of the shoots was determined. At an equivalent degree of drought stress, tolerant plants were able to resume normal growth whereas susceptible plants had died or suffered significant injury resulting in less dry matter. Proline content of the leaves and stomatal aperture were also measured at various times during the drought stress. Tolerant plants maintained a lower proline content and a greater stomatal aperture than the non-transgenic control plants.

An alternative method to impose water stress on the transgenic plants was by treatment with a solution at specific water potential, containing an osmolyte such as polyethylene glycol (PEG). The PEG treatment was given to either detached leaves (e.g. Djilianov et al., 1997 Plant Science 129: 147-156) or to the roots (Wakabayashi et al., 1997 Plant Physiol 113: 967-973). Since PEG may be toxic, the plants were given only a short term exposure. The response was measured as physical measurements such as stomatal aperture or osmotic potential, or biochemical measurements such as accumulation of proline. Tolerant plants maintained their stomatal aperture and showed only slight changes in osmotic potential, whereas the susceptible non-transgenic control plants closed their stomata and exhibited increased osmotic potential. In addition the changes in proline and other metabolites were less in the tolerant transgenic plants than in the non-transgenic control plants.

Tolerance of salinity and cold were measured using methods as described in example 3. Plants that had tolerance to salinity or cold had higher seed yields, photosynthesis and dry matter production than susceptible plants.

EXAMPLE 5

Engineering Stress-Tolerant Ryegrass Plants by Over-Expressing Stress Related Genes from *Saccharomyces cerevisiae* or *E. coli* or *Brassica napus, Glycine max*, and *Oryza sativa*

Seeds of several different ryegrass varieties may be used as explant sources for transformation, including the commercial variety Gunne available from Svalof Weibull seed company or the variety Affinity. Seeds were surface-sterilized sequentially with 1% Tween-20 for 1 minute, 100% bleach for 60 minutes, 3 rinses with 5 minutes each with de-ionized and distilled H2O, and then germinated for 3-4 days on moist, sterile filter paper in the dark. Seedlings were further sterilized for 1 minute with 1% Tween-20, 5 minutes with 75% bleach, and rinsed 3 times with ddH2O, 5 min each.

Surface-sterilized seeds were placed on the callus induction medium containing Murashige and Skoog basal salts and vitamins, 20 g/l sucrose, 150 mg/l asparagine, 500 mg/l casein hydrolysate, 3 g/l Phytagel, 10 mg/l BAP, and 5 mg/l dicamba. Plates were incubated in the dark at 25 C for 4 weeks for seed germination and embryogenic callus induction.

After 4 weeks on the callus induction medium, the shoots and roots of the seedlings were trimmed away, the callus was transferred to fresh media, maintained in culture for another 4 weeks, and then transferred to MSO medium in light for 2 weeks. Several pieces of callus (11-17 weeks old) were either strained through a 10 mesh sieve and put onto callus induction medium, or cultured in 100 ml of liquid ryegrass callus induction media (same medium as for callus induction with agar) in a 250 ml flask. The flask was wrapped in foil and shaken at 175 rpm in the dark at 23° C. for 1 week. Sieving the liquid culture with a 40-mesh sieve collected the cells. The fraction collected on the sieve was plated and cultured on solid ryegrass callus induction medium for 1 week in the dark at 25° C. The callus was then transferred to and cultured on MS medium containing 1% sucrose for 2 weeks.

Transformation can be accomplished with either *Agrobacterium* of with particle bombardment methods. An expression vector is created containing a constitutive plant promoter and the cDNA of the gene in a pUC vector. The plasmid DNA was prepared from *E. coli* cells using with Qiagen kit according to manufacturer's instruction. Approximately 2 g of embryogenic callus was spread in the center of a sterile filter paper in a Petri dish. An aliquot of liquid MSO with 10 g/l sucrose was added to the filter paper. Gold particles (1.0 µm in size) were coated with plasmid DNA according to method of Sanford et al., 1993 and delivered to the embryogenic callus with the following parameters: 500 µg particles and 2 µg DNA per shot, 1300 psi and a target distance of 8.5 cm from stopping plate to plate of callus and 1 shot per plate of callus.

After the bombardment, calli were transferred back to the fresh callus development medium and maintained in the dark at room temperature for a 1-week period. The callus was then transferred to growth conditions in the light at 25° C. to initiate embryo differentiation with the appropriate selection agent, e.g. 250 nM Arsenal, 5 mg/l PPT or 50 mg/L kanamycin. Shoots resistant to the selection agent appeared and once rotted were transferred to soil.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants were propagated vegetatively by excising tillers. The transplanted tillers were maintained in the greenhouse for 2 months until well established. The shoots were defoliated and allowed to grow for 2 weeks.

The first drought experiment was conducted in a manner similar to that described in example 3. The seedlings received no water for a period up to 3 weeks at which time the plant and soil were desiccated. At various times after withholding water, a normal watering schedule was resumed. At one week after resuming watering, the lengths of leaf blades, and the fresh and dry weights of the shoots was determined. At an equivalent degree of drought stress, tolerant plants were able to resume normal growth whereas susceptible plants had died or suffered significant injury resulting in shorter leaves and less dry matter. Proline content of the leaves and stomatal aperture were also measured at various times, during the drought stress. Tolerant plants maintained a lower proline content and a greater stomatal aperture than the non-transgenic control plants.

A second experiment imposing drought stress on the transgenic plants was by treatment with a solution of PEG as described in the previous examples. Tolerance of salinity and cold were measured using methods as described in example 3. Plants that had tolerance to salinity or cold had higher seed yields, photosynthesis and dry matter production than susceptible plants.

EXAMPLE 6

Engineering Stress-Tolerant Soybean Plants by Over-Expressing Stress Related Genes from *Saccharomyces cerevisiae* or *E. coli* or *Brassica napus, Glycine max*, and *Oryza sativa*

Soybean was transformed according to the following modification of the method described in the Texas A&M patent U.S. Pat. No. 5,164,310. Several commercial soybean varieties are amenable to transformation by this method. The cultivar Jack (available from the Illinois Seed Foundation) is a commonly used for transformation. Seeds were sterilized by immersion in 70% (v/v) ethanol for 6 min and in 25% commercial bleach (NaOCl) supplemented with 0.1% (v/v) Tween for 20 min, followed by rinsing 4 times with sterile double distilled water. Seven-day seedlings were propagated by removing the radicle, hypocotyl and one cotyledon from each seedling. Then, the epicotyl with one cotyledon was transferred to fresh germination media in petri dishes and incubated at 25° C. under a 16-hr photoperiod (approx. 100 µE-m-2s-1) for three weeks. Axillary nodes (approx. 4 mm in length) were cut from 3-4 week-old plants. Axillary nodes were excised and incubated in *Agrobacterium* LBA4404 culture.

Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,3666 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) was used to provide constitutive expression of the trait gene.

After the co-cultivation treatment, the explants were washed and transferred to selection media supplemented with 500 mg/L timentin. Shoots were excised and placed on a shoot elongation medium. Shoots longer than 1 cm were placed on rooting medium for two to four weeks prior to transplanting to soil.

The primary transgenic plants (T0) were analyzed by PCR to confirm the presence of T-DNA. These results were confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Tolerant plants had higher seed yields, maintained their stomatal aperture and showed only slight changes in osmotic potential and proline levels, whereas the susceptible non-transgenic control plants closed their stomata and exhibited increased osmotic potential and proline levels.

Tolerance of drought, salinity and cold were measured using methods as described in example 3. Plants that had tolerance to salinity or cold had higher seed yields, photosynthesis and dry matter production than susceptible plants.

EXAMPLE 7

Engineering Stress-Tolerant Rapeseed/Canola Plants by Over-Expressing Stress Related Genes from *Saccharomyces cerevisiae* or *E. coli* or *Brassica napus, Glycine max*, and *Oryza sativa*

Cotyledonary petioles and hypocotyls of 5-6 day-old young seedlings were used as explants for tissue culture and transformed according to Babic et al. (1998, Plant Cell Rep 17: 183-188). The commercial cultivar Westar (Agriculture Canada) is the standard variety used for transformation, but other varieties can be used.

*Agrobacterium tumefaciens* LBA4404 containing a binary vector was used for canola transformation. Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,3666 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) was used to provide constitutive expression of the trait gene.

Canola seeds were surface-sterilized in 70% ethanol for 2 min., and then in 30% Clorox with a drop of Tween-20 for 10 min, followed by three rinses with sterilized distilled water. Seeds were then germinated in vitro 5 days on half strength MS medium without hormones, 1% sucrose, 0.7% Phytagar at 23° C., 16 hr. light. The cotyledon petiole explants with the cotyledon attached were excised from the in vitro seedlings, and inoculated with *Agrobacterium* by dipping the cut end of the petiole explant into the bacterial suspension. The explants were then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants were transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots were 5-10 mm in length, they were cut and transferred to shoot elongation medium (MSBAP-0.5, containing 0.5 mg/l BAP). Shoots of about 2 cm in length were transferred to the rooting medium (MS0) for root induction.

Samples of the primary transgenic plants (T0) were analyzed by PCR to confirm the presence of T-DNA. These results were confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

The transgenic plants were then evaluated for their improved stress tolerance according to the method described in Example 3. Tolerant plants had higher seed yields, maintained their stomatal aperture and showed only slight changes in osmotic potential and proline levels, whereas the susceptible non-transgenic control plants closed their stomata and exhibited increased osmotic potential and proline levels.

Tolerance of drought, salinity and cold were measured using methods as described in the previous example 3. Plants that had tolerance to salinity or cold had higher seed yields, photosynthesis and dry matter production than susceptible plants.

EXAMPLE 8

Engineering Stress-Tolerant Corn Plants by Over-Expressing Stress Related Genes from *Saccharomyces cerevisiae* or *E. coli* or *Brassica napus, Glycine max*, and *Oryza sativa*

Transformation of maize (*Zea Mays* L.) is performed with a modification of the method described by Ishida et al. (1996. Nature Biotech 14745-50). Transformation is genotype-dependent in corn and only specific genotypes are amenable to transformation and regeneration. The inbred line A188 (University of Minnesota) or hybrids with A188 as a parent are good sources of donor material for transformation (Fromm et al. 1990 Biotech 8:833-839), but other genotypes can be used successfully as well. Ears are harvested from corn plants at approximately 11 days after pollination (DAP) when the length of immature embryos is about 1 to 1.2 mm. Immature embryos are co-cultivated with *Agrobacterium tumefaciens* that carry "super binary" vectors and transgenic plants are recovered through organogenesis. The super binary vector system of Japan Tobacco is described in WO patents WO94/00977 and WO95/06722. Vectors were constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) was used to provide constitutive expression of the trait gene.

Excised embryos are grown on callus induction medium, then maize regeneration medium, containing imidazolinone as a selection agent. The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the imidazolinone herbicides and which are PCR positive for the transgenes.

The T1 transgenic plants were then evaluated for their improved stress tolerance according to the method described in Example 3. The T1 generation of single locus insertions of the T-DNA will segregate for the transgene in a 3:1 ratio. Those progeny containing one or two copies of the transgene are tolerant of the imidazolinone herbicide, and exhibit greater tolerance of drought stress than those progeny lacking the transgenes. Tolerant plants had higher seed yields, maintained their stomatal aperture and showed only slight changes in osmotic potential and proline levels, whereas the susceptible non-transgenic control plants closed their stomata and exhibited increased osmotic potential and proline levels. Homozygous T2 plants exhibited similar phenotypes. Hybrid plants (F1 progeny) of homozygous transgenic plants and non-transgenic plants also exhibited increased environmental stress tolerance.

Tolerance of salinity and cold were measured using methods as described in the previous example 3. Plants that had tolerance to drought, salinity or cold had higher seed yields, photosynthesis and dry matter production than susceptible plants.

EXAMPLE 9

Engineering Stress-Tolerant Wheat Plants by Over-Expressing Stress Related Genes from *Saccharomyces cerevisiae* or *E. coli, Brassica napus, Glycine max*, or *Oryza sativa*

Transformation of wheat is performed with the method described by Ishida et al. (1996 Nature Biotech. 14745-50). The cultivar Bobwhite (available from CYMMIT, Mexico) is commonly used in transformation. Immature embryos are co-cultivated with *Agrobacterium tumefaciens* that carry "super binary" vectors, and transgenic plants are recovered through organogenesis. The super binary vector system of Japan Tobacco is described in WO patents WO94/00977 and WO95/06722. Vectors were constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) was used to provide constitutive expression of the trait gene.

After incubation with *Agrobacterium*, the embryos are grown on callus induction medium, then regeneration medium, containing imidazolinone as a selection agent. The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the imidazolinone herbicides and which are PCR positive for the transgenes.

The T1 transgenic plants were then evaluated for their improved stress tolerance according to the method described in the previous example 3. The T1 generation of single locus insertions of the T-DNA will segregate for the transgene in a 3:1 ratio. Those progeny containing one or two copies of the transgene are tolerant of the imidazolinone herbicide, and exhibit greater tolerance of drought stress than those progeny lacking the transgenes. Tolerant plants had higher seed yields, maintained their stomatal aperture and showed only slight changes in osmotic potential and proline levels, whereas the susceptible non-transgenic control plants closed their stomata and exhibited increased osmotic potential and proline levels. Homozygous T2 plants exhibited similar phenotypes. Tolerance of salinity and cold were measured using methods as described in the previous examples. Plants that had tolerance to drought, salinity or cold had higher seed yields, photosynthesis and dry matter production than susceptible plants.

EXAMPLE 14

Identification of Identical and Heterologous Genes

Gene sequences can be used to identify identical or heterologous genes from cDNA or genomic libraries. Identical genes (e.g. full-length cDNA clones) can be isolated via nucleic acid hybridization using for example cDNA libraries. Depending on the abundance of the gene of interest, 100,000 up to 1,000,000 recombinant bacteriophages are plated and transferred to nylon membranes. After denaturation with alkali, DNA is immobilized on the membrane by e.g. UV cross linking. Hybridization is carried out at high stringency conditions. In aqueous solution, hybridization and washing is performed at an ionic strength of 1 M NaCl and a temperature of 68° C. Hybridization probes are generated by e.g. radioactive ($^{32}P$) nick transcription labeling (High Prime, Roche, Mannheim, Germany). Signals are detected by autoradiography.

Partially identical or heterologous genes that are related but not identical can be identified in a manner analogous to the above-described procedure using low stringency hybridization and washing conditions. For aqueous hybridization, the ionic strength is normally kept at 1 M NaCl while the temperature is progressively lowered from 68 to 42° C.

Isolation of gene sequences with homology (or sequence identity/similarity) only in a distinct domain of (for example 10-20 amino acids) can be carried out by using synthetic radio labeled oligonucleotide probes. Radiolabeled oligonucleotides are prepared by phosphorylation of the 5-prime end of two complementary oligonucleotides with T4 polynucleotide kinase. The complementary oligonucleotides are annealed and ligated to form concatemers. The double stranded concatemers are than radiolabeled by, for example, nick transcription. Hybridization is normally performed at low stringency conditions using high oligonucleotide concentrations. Oligonucleotide hybridization solution:

6×SSC
0.01 M sodium phosphate
1 mM EDTA (pH 8)
0.5% SDS
100 μg/ml denatured salmon sperm DNA
0.1% nonfat dried milk During hybridization, temperature is lowered stepwise to 5-10° C. below the estimated oligonucleotide $T_m$ or down to room temperature followed by washing steps and autoradiography. Washing is performed with low stringency such as 3 washing steps using 4×SSC. Further details are described by Sambrook, J. et al., 1989, "Molecular Cloning: A Laboratory Manual," Cold Spring Harbor Laboratory Press or Ausubel, F. M. et al., 1994, "Current Protocols in Molecular Biology," John Wiley & Sons.

EXAMPLE 15

Identification of Identical Genes by Screening Expression Libraries with Antibodies c-DNA clones can be used to produce recombinant polypeptide for example in *E. coli* (e.g. Qiagen QIAexpress pQE system). Recombinant polypeptides are then normally affinity purified via Ni-NTA affinity chromatography (Qiagen). Recombinant polypeptides are then used to produce specific antibodies for example by using standard techniques for rabbit immunization. Antibodies are affinity purified using a Ni-NTA column saturated with the recombinant antigen as described by Gu et al., 1994, BioTechniques 17:257-262. The antibody can than be used to screen expression cDNA libraries to identify identical or heterblogous genes via an immunological screening (Sambrook, J. et al., 1989, "Molecular Cloning: A Laboratory Manual," Cold Spring Harbor Laboratory Press or Ausubel, F. M. et al., 1994, "Current Protocols in Molecular Biology", John Wiley & Sons).

EXAMPLE 16

In Vivo Mutagenesis

In vivo mutagenesis of microorganisms can be performed by passage of plasmid (or other vector) DNA through *E. coli* or other microorganisms (e.g. *Bacillus* spp. or yeasts such as *Saccharomyces cerevisiae*) which are impaired in their capabilities to maintain the integrity of their genetic information. Typical mutator strains have mutations in the genes for the DNA repair system (e.g., mutHLS, mutD, mutT, etc.; for reference, see Rupp, W. D., 1996, DNA: repair mechanisms, in: *Escherichia coli* and *Salmonella*, p. 2277-2294, ASM: Washington.) Such strains are well known to those skilled in the art. The use of such-strains is illustrated, for example, in Greener, A. and Callahan, M., 1994, Strategies 7; 32-34. Transfer of mutated DNA molecules into plants is preferably done after selection and testing in microorganisms. Transgenic plants are generated according to various examples within the exemplification of this document.

EXAMPLE 17

Identification and Analysis of YNL090W Homologs

Transgenic *Arabidopsis* plants overexpressing YNL 090W (ORF 3165) lived 4.33 days longer than the wild type control under drought conditions. The protein sequence of YNL090W was used to identify related gene sequences of expressed sequence tags (ESTs) proprietary libraries constructed from *Oryza sativa* cv. Noppon-Brarre (a japonica rice), *Brassica napus* cv. "AC Excel" "Quantum" and "Cresor" (canola), and *Glycine max* cv. Resuick (soybean) by Blast analysis (Altschul S F, Gish W, Miller W, Myers E W, Lipman D J. 1990 J Mol Biol 21593:403-10).

The plant cDNA sequences were translated into a predicated amino acid sequences, and relationship among the amino acids sequences was determined by sequence alignment using the clustal W alogorithm in Vector NTI Version 7 as shown in the drawing.

They have 75% similarity overall. In general, proteins having conserved domains referred to as I (GXXXGKT), II (DXXG), III (VGTK), IV (EXSS), and E (FXXXYXX), are classified as small GTPases. All five domains in the proteins as shown in the drawing are more conserved than in other known small GTPases, particularly Domain I (KXVXXGDXXXGKT) (SEQ ID NO: 557), Domain E (FXXXYXXTV) (SEQ ID NO: 558), Domain II (WDTAGQE) (SEQ ID NO: 559) and Domain III (VGTKXDL) (SEQ ID NO: 560). In addition, polybasic amino acids in C terminus are shown in the drawing, as well as a C-terminal CML domain (wherein A is an aliphatic amino acid), which is the signature sequence for post translational modification by the enzyme geranylgeranyltransferase 1. Another important Rho-specific feature was shown in most proteins in the drawing is the highly conserved amino acids between Domain II and Domain III.

All the references described above are incorporated by reference in its entirety for all useful purposes.

While there is shown and described certain specific examples embodying the invention, it will be manifest to those skilled in the art that various modifications and rearrangements of the parts may be made without departing from the spirit and scope of the underlying inventive concept and that the same is not limited to the particular examples herein shown and described.

---

SEQUENCE LISTING (852 sequences)

SEQ ID NO: 1 - DNA, 1143 bp, Saccharomyces cerevisiae
  CDS (1)..(1143)
atggatggagccaaatttgaaaatactgtagcttttttaccatctgaaatatttgattgctacaattccacgctacccaagaatgtattccgaagttttgttacctggtcctgctatgagaaattcaattccttagaattccgcacttggctattaatgtggttaccactcattattgcgtggaaaatacgtggtaaaagacactatctcgttatcgttactgctcttatgtttgaagtgctgtatttcttatggacatattcgtacatattccgagaacgcaccttaggaaagcaagtttctcaatttgctaaagagatcattacaaatactccgggtatagacactgaagactgggaacgtgttgcagtaaatttcaattcttatttatatgaaaataaactttggaatactgagtactttttttttgatggttccagctgccaagaagcgttcagaaagatgcttcttgagccattttccttgaaaaaaaatgactttgctaatgccaaggtacctgacggatctgtttgttacactgaaaaagctttgcaggtttattttacacagatagagagaaaatggcactggattaattctgaaggatttttacacaataaaaccacacagagtgttcaattttcgaaacatggttacggttccaaacttctctgggctttcaaggaagtgacaataatgaattcacgctttgcgttcttcagtattgcttacttaaacggtctccttactataccaagactaagaaattcactgcatatcctctatgtatgtgcagttctttcatctatgataattgaatatttaatagggatcgacaaattcaggttcaaatcaatgaatctgatacataaactacagttcttgtcatatattacatgtggacacgagaagtctgatgcaactaattggtctcaaattgcgaagaggacgaatacttacatgtttgagcagaaaatttggaattcgccaatactgttctcagatggtattgattgtgaaaagttttttaaatggtatttcagtacccctgtatcttcgcaagcgtctttgtcagttggttccactgattttgaactctggccatatataaaagaagcacaatcagcttgcaatgatgtgtaa

SEQ ID NO: 2 - protein, 380 aa, Saccharomyces cerevisiae
MDGAKFENTVAFLPSEIFDCYNSTLPKNVFRSFVTWSCYEKFNSLEFRTWLLMWLPLIIAWKIRGKRHYLVIVTALMFEVLYFLWTYSYIFRERTLGKQVSQFAKEIITNTPGIDTEDWERVAVNFNSYLYENKLWNTEYFFFDGSSCQEAFRKMLLEPFSLKKNDFANAKVPDGSVCYTEKALQVYFTQIERKWHWINSEGFLHNKTTQSVQFSKHGYGSKLLWAFKEVTIMNSRFAFFSIAYLNGLLTIPRLRNSLHILYVCAVLSSMIIEYLIGIDKFRFKSMNLIHKLQFLSYITCGHEKSDATNWSQIAKRTNTYMFEQKIWNSPILFSDGIDCEKFFKWYFSTPVSSQASLSVGSTDFELWPYIKEAQSACNDV

SEQ ID NO: 3 - DNA, 1389 bp, Saccharomyces cerevisiae
  CDS (1)..(1389)
atgagcgaaataaataatgaaaatctagagccaacctcaagtacagtagctgagtctacagaaagcaagaataaacacattcgtagcgctttaagaaaacgaagaggtaaattaagcgcccaaacttatgaggaagatcaagaggctattttatcatctcctttattgacttcaacacctaaaacagtctccaggtcattagtgaggttatacccatatttaattgttgtggataactttctaagtatcatcacttggtccaatgacaatgtctctgcaaacttgcttggaatattcttatttacggtttgtgttctatattttggatttattacaaggtattttggacatttaatgatcgttggtataatatgggtatatcttttaattgacaagcacgttcaagaaacaatggcatcttgcccttcattggatgatataatacacgttatggatagggtttctatgaaatctagcgctgtgttatctcctattacgattttgagcgctcaggatgttagaagactgttatttaccattgccttcctatccccagtttatatttttctaacagtgtttgtgctatctccaaactatttaatgttaatagggggtctgtatgtgcttacgtaccattctaaactaatccgaagaatgagaagatacttgtggaaatttcgcgttgttagattacttgtatttttcataacaggattagaccttggtggaccagataataataggcgcttgtttgcttctgtcaataagaaaataaggtcctttgtttggaatgaggtagggaacacatctaacactaaaaagactgtacttttcaaggttgctctgtttgaaaaccagcgccgctggcttggcatcggatggacatcaactatgttgagttatgagcgcgcatcttggacagatgaattcctaaatacttctccaagcccagaagtgtttactttaccagaggagcagtcgggaatggcttgggaatggcacgataaagattggatgcttgacctaacaaatgatgggatcattcaacttcctgcttctgctgctaagacaaaagttaagccaggtgcagatgaaggtttcatatattatgataacacctggaataatccctctgcaacggacacatataaaaagtacacaagaagaaggaggtggatcaggactgcaacagtaacaacaacgtatgacgatgagcccactgtagaaaaagctacaccgaattctcatgctctgaagagtgaagaaaataatagagttagaaaaagaaaagtgtcatttagtacagcaaatgaagtgcatatcataccttcctcggacagtagcaaattaatacaaatatctgatgtttcaatgtctccttctctataa

SEQ ID NO: 4 - protein, 462 aa, Saccharomyces cerevisiae
MSEINNENLEPTSSTVAESTESKNKHIRSALRKRRGKLSAQTYEEDQEAILSSPLLTSTPKTVSRSLVRLYPYLIVVDNFLSIITWSNDNVSANLLGIFLFTVCVLYFGFITRYFGHLMIVGIIWVYLLIDKHVQETMASCPSLDDIIHVMDRVSMKSSAVLSPITILSAQDVRRLLFTIAFLSPVYIFLTVFVLSPNYLMLIGGLYVLTYHSKLIRRMRRYLWKFRVVRLLVFFITGLDLGGPDNNRRLFASVNKKIRSFVWNEVGNTSNTKKTVLFKVALFENQRRWLGIGWTSTMLSYERASWTDEFLNTSPSPEVFTLPEEQSGMAWEWHDKDWMLDLTNDGIIQLPASAAKTKVKPGADEGFIYYDNTWNNPSATDTYKKYTRRRRWIRTATVTTTYDDEPTVEKATPNSHALKSEENNRVRKRKVSFSTANEVHIIPSSDSSKLIQISDVSMSPSL

SEQ ID NO: 5 - DNA, 3921 bp, Saccharomyces cerevisiae
  CDS (1)..(3921)
atgcagtttccattcgcttgtctcctatcgacccttgtaattagtgggtcattggcccgggccagccccttcgactttatattcggcaatggaacgcaacaagctcagagccaaagcgagagtcaaggtcaagtttctttcaccaatgaagcttctcaggatagttccaccacctctttggtaacagcctattctcaaggtgttcattcgcaccagtctgcaacaatagtgagtgccacaatctcttccctcccatctacttggtatgatgcgagctccacttcccagacttctgtgtcatatgccagtcaagaatccgactatgccgttaatcaaaactcttggagcgcgtctactaatcaactgccatctaccagtacgacaagctactatgcgccaaccttcagtacatcggccgattttgctgcttctagtgtaaatgcagcttctgatgtctccactgccagtgttcccattgatacgagtgctaattctatccctttcacaactacaagtaacatagagactacaacgagtgcacctctcacttcggacactccacttatttccactagtacgatgtccgcagctgataacgtattttcgtcagcaaaccctatttctgcctccctaacaaccaccgatagttcagaaagttttgaccaaacttcgactgctggtgccattccggtgcaaagttcagcagattttagtagttctagtgaaattttagtacaaagttcggcggatttcagtagccctagttctccaactactaccgatatatcgctatcagctgccccactgcaaacaagtgaatcaagcagttttaccactgcatcagcagctctaccagtaagttcaacagacgttgatggctcaagcgcctcacctgtagtgagcatgagcgccgcaggacaaatagctagctcaagcagcacagataatccaactatgtcagaaaccttttcgttaacatctacagaagttgatggttccgatgtttcatcaacagtgagcgcattattatcggctccttttttacaaacaagtacttccaacagtttcagcattgttagcccatcggtatcttttgttccatcacagagttcctcagacgttgctagctccagtactgcaaatgtagttagttcatccttttctgatattccaccgcaaactagtacctcagggagcgtagtttcggtagcgcaatccgcatctgccctcgcatttcaaagttcaacagaggtatatggtgccagtgcctcgagcacaatgagttcattattatcaactacttcgctacagtctactactttggatagctcaagtttagctagctcctctgcgtcgagttcagaccttacagattatggcgtctccagtacagcaagcataccgctgttgtcagcctcagaacaagcaagtacttccagcagttttagcgttgttagcccttcggtatcttttgttccatcacaaagttcctcagatgttgctagcaccagtgctccaagtgtagttagttcatccttttcttatacttcactgcaagcaggtggctctagcatgaccaatccctcttcatcaactatagtatattcaagtagtactggcagttctgaggaatccgctgcatctacagcttctgcaacactgtcgggctcctcgtctacttatatggcaggaaatttgcaatcacagcctccatccacttcaagtttgctttcggagtctcaagctacaagcacttcagctgtgctagctagcagttctgtttctacaacttcaccctataccactgcaggtggtgcatctacagaggcctcatccctcatatcatctacatctgcggaaacttcccaggtaagttattcacaaagcacaactgcattgcaaacttcctcattcgcatcgtcttcaacaacagaaggaagtgaaacatctagtcaaggtttttctaccagctctgttttagttcaaatgccttcttcgatttccagcgaattctcaccctctcagacgacaactcaaatgaattctgcaagctcatcatctcagtacactatatcatccactggtatactttctcaggtttcagacacatcggtgtcttatacaacttcaagttcgtctgtttctcaagtttcagacacaccagtttcttatacaacttcaagttcgtctgtttctcaagtttcagacacaccggtttcttatacaacttcaagttcgtctgtttctcaagtttcagacacaccagtttcttatacaacttcaagttcatctgtttctcaagtttcagacacaccggtttcttatacaacttcaagttcgtccgtttctcaagtttcagacacgtcagtaccttctacaagttccagatcgtccgtttctcaagtctcagacactccggtgccttctacaagttcaaggtcgtccgtttctcaaacatctagctcactacagcccaccactacatcctcccaacgtttcaccatttccactcatggagcgctttctgaaagtagttctgttagccaacaagcttctgagattactagctcaatcaatgcaacagcttccgaataccatagcatccagacaaccgcggctactcaatccacaactctatcttttaccgacgcaaacagcagttctgcttccgctccattggaagtggcaacgtctacgccaaccccatcttcaaaggcatcctctctgttgcttacaccatcaacatcctctttaagtcaggttgctacaaatactaatgtacagacgagtttaacaacggaatcgacgaccgttttagaaccatcaacgactaacagttccagtacgtttagtctggtcacttcaagtgacaacaattggtggattccaactgagttaatcacgcaggcaccagaagctgcatccactgcatcttctaccgttggaggaacacaaactatgactttgccccatgcaattgcagccgcgacacaagttcccgagcctgagggctacaccctaatcacaatagggttcaaaaaagctttgaactacgaatttgttgtatcagaaccaaaatcatcggctcaaatcttcggatacttgcctgaagctctgaacacaccttttaagaacgtattcacaaacattacggtactacaaatagtgccattacaggatgactcactcaactacttagtaagtgttgctgaagtatactttccaactgcagaaatagaggagctgtcaaatctaattaccaactcttcaagcgctttttacacggatggaatgggtacagcaaaatctatggctgcaatggttgattcctcaataccgctaacgggcctcttacacgatagtaacagcaactctggcggatcttcggacggatcctcctccagtaattcgaactcaggatcttcaggttcaggatctaattcgaactccggtgtgtcttcatcttccggaaattcctatcaagatgccggtactttggaatattcatccaaatctaactccaacgtatccacttctagcaaatcaaagaaaaaaatcattggtttagttatcggcgttgttgttggtggatgcttatatattttattcatgatttttgctttcaagtatatcataagaaggcggattcaaagtcaagaaattatcaagaacccagaaatttccagtatcagttcaagtgaatttggtggagagaaaaattacaataatgaaaagagaatgagcgttcaagaatccataacacaatctatgcgaattcaaaattggatggatgatagttactatggtcacgggttgacaaataatgactcaactccaaccaggcacaatacatcgagttccataccaaaaatttcaagaccaattgctagccaaaactccctgggttggaacgaagtttga

SEQ ID NO: 6 - protein, 1306 aa, Saccharomyces cerevisiae
MQFPFACLLSTLVISGSLARASPFDFIFGNGTQQAQSQSESQGQVSFTNEASQDSSTTSLVTAYSQGVHSHQSATIVSATISSLPSTWYDASSTSQTSVSYASQESDYAVNQNSWSASTNQLPSTSTTSYYAPTFSTSADFAASSVNAASDVSTASVPIDTSANSIPFTTTSNIETTTSAPLTSDTPLISTSTMSAADNVFSSANPISASLTTTDSSESFDQTSTAGAIPVQSSADFSSSSEILVQSSADFSSPSSPTTTDISLSAAPLQTSESSSFTTASAALPVSSTDVDGSSASPVVSMSAAGQIASSSSTDNPTMSETFSLTSTEVDGSDVSSTVSALLSAPFLQTSTSNSFSIVSPSVSFVPSQSSSDVASSSTANVVSSSFSDIPPQTSTSGSVVSVAQSASALAFQSSTEVYGASASSTMSSLLSTTSLQSTTLDSSSLASSSASSSDLTDYGVSSTASIPLLSASEQASTSSSFSVVSPSVSFVPSQSSSDVASTSAPSVVSSSFSYTSLQAGGSSMTNPSSSTIVYSSSTGSSEESAASTASATLSGSSSTYMAGNLQSQPPSTSSLLSESQATSTSAVLASSSVSTTSPYTTAGGASTEASSLISSTSAETSQVSYSQSTTALQTSSFASSSTTEGSETSSQGFSTSSVLVQMPSSISSEFSPSQTTTQMNSASSSSQYTISSTGILSQVSDTSVSYTTSSSSVSQVSDTPVSYTTSSSSVSQVSDTPVSYTTSSSSVSQVSDTPVSYTTSSSSVSQVSDTPVSYTTSSSSVSQVSDTSVPSTSSRSSVSQVSDTPVPSTSSRSSVSQTSSSLQPTTTSSQRFTISTHGALSESSSVSQQASEITSSINATASEYHSIQTTAATQSTTLSFTDANSSSASAPLEVATSTPTPSSKASSLLLTPSTSSLSQVATNTNVQTSLTTESTTVLEPSTTNSSSTFSLVTSSDNNWWIPTELITQAPEAASTASSTVGGTQTMTLPHAIAAATQVPEPEGYTLITIGFKKALNYEFVVSEPKSSAQIFGYLPEALNTPFKNVFTNITVLQIVPLQDDSLNYLVSVAEVYFPTAEIEELSNLITNSSSAFYTDGMGTAKSMAAMVDSSIPLTGLLHDSNSNSGGSSDGSSSSNSNSGSSGSGSNSNSGVSSSSGNSYQDAGTLEYSSKSNSNVSTSSKSKKKIIGLVIGVVVGGCLYILFMIFAFKYIIRRRIQSQEIIKNPEISSISSSEFGGEKNYNNEKRMSVQESITQSMRIQNWMDDSYYGHGLTNNDSTPTRHNTSSSIPKISRPIASQNSLGWNEV

SEQ ID NO: 7 - DNA, 315 bp, Saccharomyces cerevisiae
  CDS (1)..(315)
atgaaatttttgaagaacaaagcacctgctaatctggtggataacggcaggtttgtggaagcaataacgtgcaataaagttaaaccgaatccatcttgcgtctccaactgcctcaaatttctttccgaagttttagcggtagaagcaataactgattcggccagaaatttagctacggtttccaaatcggacatcctactattttctcttctacaattgagtagcaataaacagagcgggtcctctttgccactttttgatcttgtgtttatactactttcaactttttttttattccataatccctgcaattga

SEQ ID NO: 8 - protein, 104 aa, Saccharomyces cerevisiae
MKFLKNKAPANLVDNGRFVEAITCNKVKPNPSCVSNCLKFLSEVLAVEAITDSARNLATVSKSDILLFSLLQLSSNKQSGSSLPLFDLVFILLSTFFLFHNPCN

SEQ ID NO: 9 - DNA, 2064 bp, Saccharomyces cerevisiae
  CDS (1)..(2064)
atgtgcgccagtttaaacgaggtaaaaaagaatgacacctatggggtctcacaaaagggctacaatgacaatttcagtgaaagtgagggcgtccttcatggtagtaagtcgatgcccactagcatgaaaaatatgctacagtctcccacgatggtcaacatgtgtgatattttacaaaacaaggaagctgctaatgacgaaaaacctgtgatacctactacggataccgccactgcggggactggtactgaagatattagctccactcaatccgaggaaactgatcagaatagtcatcttattgcctcagagatcttggaaggcactttcaaagatgtatcttacaaggaatatgcaaatttcttgggaaacgataacaataatcaagtcttgactgagtttgtaaagttattgagtcctttgccgtcgtcactattagaaacgcttttcaatttatcgaaaagtatatatttcattgcagaagcgcaaaatatcgaccggatactagagtgcttgagcatagaatggatagcttgccacccgaacacacattggaagtcaggctataagtcatgtcatatagtcttattttccctgttgatccttaattcggatttgcacaacaactttcaagttgaccataaaaagattaagttttccatggttgcatttatcaacaatacactgagggcactaagagaggaaaatgaatacgaagaattgaaaatatactcccgcgaacatttgatcatcgaagaactttccgaatactataaaacgttaaatgaaacgcctttaccgttatgcacagaatctagaacatcaataaatatatcagataaccaatcttccttgaaaaggttctctactctaggatcacgggaatttagtacatcaaatttacgtagtgttaactctaattctactacactatattcaagagatggtcaagtatctgtacgagaaatgagcgcaaaatcaaataaaaactttcacaataatcaccccatggatgcactctaccttaaagagtcttttgatgacggtttaattaccgaaaacggctccagttggttcatggacgatttaattcttataagcaagaaatctttaccacgtaaatattctaaaagagacaaagatcaagtggcggcaccaaaaatgacctctaagagaaacaaatcgttcttcggatggctaaaaccatctaaaacgactacacttattgagcacacatctagaaggacttctttatcgtatttgaataaggattctgaatgggagagggtgaaaatacaggtcaaggagggcagaatttttattttcaaaattaaaccagatgttaaggatatcatccaatcaagtgaaacagacagtgctaccatcgactatttcaaagatatcagtagctcttattttgcttactcactgcttgaagctgaagcacatgtcgtgcaagataatataattataggtagtggagcaatgaaatcaaatgtgtgtaacaaaaacaccaagaggaaaagtggcaactttaccgttagttttccagagaatatcaacggaccaaagcttgttctggagttccagacgagaagtgttgaagaagcccacaagtttatggactgtatcaacttctgggcaggtaggatttctccagttcctttaacacaattcgaagccgtatctaacgcagaatatggatggagtgacaagatcttgacagagcacgcttccctcaatcttaaaaatattgttgtaagtgaatggaagccactattggggctagagctactatacgaagatgcgaaagatgtagagatggtcgaactaaaagaaaggctaaaggaattgatgaacttcaccagacagcttggtatatggatagataaacataacgaaataaaggataagctggtcgaaatttggagctttgacgataactattttgaagcagtcatgaataattggaattcgagatatttgtatatgaataatcaatataagaaacgactgagctacttgaaagctttgcaaaaagccatgggttctgttcagttctaa

SEQ ID NO: 10 - protein, 687 aa, Saccharomyces cerevisiae
MCASLNEVKKNDTYGVSQKGYNDNFSESEGVLHGSKSMPTSMKNMLQSPTMVNMCDILQNKEAANDEKPVIPTTDTATAGTGTEDISSTQSEETDQNSHLIASEILEGTFKDVSYKEYANFLGNDNNNQVLTEFVKLLSPLPSSLLETLFNLSKSIYFIAEAQNIDRILECLSIEWIACHPNTHWKSGYKSCHIVLFSLLILNSDLHNNFQVDHKKIKFSMVAFINNTLRALREENEYEELKIYSREHLIIEELSEYYKTLNETPLPLCTESRTSINISDNQSSLKRFSTLGSREFSTSNLRSVNSNSTTLYSRDGQVSVREMSAKSNKNFHNNHPMDALYLKESFDDGLITENGSSWFMDDLILISKKSLPRKYSKRDKDQVAAPKMTSKRNKSFFGWLKPSKTTTLIEHTSRRTSLSYLNKDSEWERVKIQVKEGRIFIFKIKPDVKDIIQSSETDSATIDYFKDISSSYFAYSLLEAEAHVVQDNIIIGSGAMKSNVCNKNTKRKSGNFTVSFPENINGPKLVLEFQTRSVEEAHKFMDCINFWAGRISPVPLTQFEAVSNAEYGWSDKILTEHASLNLKNIVVSEWKPLLGLELLYEDAKDVEMVELKERLKELMNFTRQLGIWIDKHNEIKDKLVEIWSFDDNYFEAVMNNWNSRYLYMNNQYKKRLSYLKALQKAMGSVQF

SEQ ID NO: 11 - DNA, 678 bp, Saccharomyces cerevisiae
  CDS (1)..(678)
atggtcgtaattaacggggtcaaatatgcctgtgaaacgtgtatcaggggtcacagggcggcgcagtgtactcacactgatggtccgctacagatgatcagacgcaagggaagaccatcgaccacatgtggccattgtaaagagctgagaagaaccaagaacttcaacccatccggtgggtgcatgtgtgcctctgcacgacggccagctgttggcagcaaggaagatgaaacacgatgtcgttgtgatgagggtgaaccttgtaaatgtcataccaagaggaaaagcagccggaaatcaaagggagggtcatgccacagaagggcaaatgatgaagcagcgcatgtcaatggtctcggtattgcagatctggacgttcttttgggcctaaatggtcgctcgtcggatgtagacatgacaaccacattgccgagtttgaagccacctctgcaaaacggagaaattaaggccgacagcattgacaatcttgatttggcttccctcgatccgcttgagcaaagccctagtatatctatggaacctgttagtatcaatgaaacaggaagcgcatatacaactacgaacacagcactaaacgatattgacattccattctccatcaatgagttgaacgagctatacaaacaagtatcttcgcataactcacattcacaataa

SEQ ID NO: 12 - protein, 225 aa, Saccharomyces cerevisiae
MVVINGVKYACETCIRGHRAAQCTHTDGPLQMIRRKGRPSTTCGHCKELRRTKNFNPSGGCMCASARRPAVGSKEDETRCRCDEGEPCKCHTKRKSSRKSKGGSCHRRANDEAAHVNGLGIADLDVLLGLNGRSSDVDMTTTLPSLKPPLQNGEIKADSIDNLDLASLDPLEQSPSISMEPVSINETGSAYTTTNTALNDIDIPFSINELNELYKQVSSHNSHSQ

SEQ ID NO: 13 - DNA, 750 bp, Saccharomyces cerevisiae
  CDS (1)..(750)
atgttgcagctaaggtttatgcctggatgggtccccagaaatggtttttttggtttgaaggagacaattggtacagtacataagagattttatgctctggcttctgaacaaccctcaagaaagacagtaaagccgctggactcgaggaagacgtttctcatcgatacatacaagcatttaatggagaacagttctatgattttttttgtccattacaataatctttccaaaacagaagatcaccatttcagattcaagattaaacagacaggagggaaactcacaaaagtaagaaacaacctgttcgaagtctacttgagaaattcgcatctgcccgacccatgtggattcgtgaagcgtaaagagcaaaactggaaacatccactcttgccactactgaagggtcctacggccacaattacatacgaagacaccaaccctcaacaagtagccaagctattgaaggttctgcagtcagcacaagacaagctgatggtgattggtgcaaaagtagaaaacgaagttttgaatgtggaaaaaataaacacttttaagactctccccacaaagccggaaatgcagtcgcagttagtcagcgttttgcaaatgctaagtgggttgggtttggttcgtacgttggaaaacagttcaaatgcattgtatttaacactaaaatctcacaatgacaaccaaaaacctaaagaggatgtggagtcaactacagatgcagaatcgaagggatcaaagtaa

SEQ ID NO: 14 - protein, 249 aa, Saccharomyces cerevisiae
MLQLRFMPGWVPRNGFFGLKETIGTVHKRFYALASEQPSRKTVKPLDSRKTFLIDTYKHLMENSSMIFFVHYNNLSKTEDHHFRFKIKQTGGKLTKVRNNLFEVYLRNSHLPDPCGFVKRKEQNWKHPLLPLLKGPTATITYEDTNPQQVAKLLKVLQSAQDKLMVIGAKVENEVLNVEKINTFKTLPTKPEMQSQLVSVLQMLSGLGLVRTLENSSNALYLTLKSHNDNQKPKEDVESTTDAESKGSK

SEQ ID NO: 15 - DNA, 357 bp, Saccharomyces cerevisiae
  CDS (1)..(357)
atgaagctcccacagaccatgctacgttctatatctgtgaagcatgtccggtggccaaggattctgacgggctcaaagctttggtactcaacgcagatggcaatgactccggaggagaagatgatcaccgataaactacaacaggaactggaacctgaagtgtgtaaagtgcaagacgtttccggtggctgcggatccatgtttgctatcaacataacaagcaagaagttcaacggactgagtctcatcaagcagcaccagctggtgaacagaattttgagggacgatatttccagatggcatggcctacaattgaccactaagaagtcaactgggaagggtccggcatcatcatga

SEQ ID NO: 16 - protein, 118 aa, Saccharomyces cerevisiae
MKLPQTMLRSISVKHVRWPRILTGSKLWYSTQMAMTPEEKMITDKLQQELEPEVCKVQDVSGGCGSMFAINITSKKFNGLSLIKQHQLVNRILRDDISRWHGLQLTTKKSTGKGPASS

SEQ ID NO: 17 - DNA, 1782 bp, Saccharomyces cerevisiae
  CDS (1)..(1782)
atggctctagctatctcccacgaggatactcagattttgctaaaggacaaaaatattctacaggaatcggtcttgaacaaatacagaactgctggacaaatcgcacaaactgctttgaaatatgttacttctttgatcaatgattcatatcactctaagaccacacagcgccaattaaccgtgccagagctatgtttgcttaccgattcttttattttgacccggttggaacaatattataaaaacaaagttaatgaaagaggtattgccattccaaccactattgatatcgaccaaatttctggtggatggtgccccgaaatagatgatactcaaaatttgttaaactggaataaggggaaagactccacttttgcatcatctgtcactgggactttgagaccgggggatttagtcaagattacactaggtgttcatattgatggttacacctctgaagtttctcatactatggttatttaccccgttgatgaaaccaaacctattcttcaacccactgggccactactaggtggtaaagcggatgctgtagctgctgctcacattgctatggaaacagttgttgctttattagcctgtgctctgactccagaaaagcttcctgcctcactgggaggaacttcaagtggtatcacaggccaattgattagaactatagtggatactattgccagatcttataactgtggcgttgttcctggttctcgtgtaagaaggattagaagattcctggcaggccaaaacgaaggtattgttgccgaaagggaatataagggtgttgtttggacagagtcccatcaagaagcagatttgctatctaatactgatgccaaggatttaacagtggtagatcgtggacaatcgactccattcactaatgtttctgctattccaagtgatgatttcgttgttcaatcaggtgaagtgtatttaattgatttgaaaatggcatctttggagcattgtaccaaaaagggtttagtaactttagaaaccgttgactcttacacaggtaaatctcataaggctggagaattgattgcaagacccggtgcatatgttagagattttgctcaaacccatattcttaaattaaaaacttctagacaattattaactaaaatcgataaacaaggcgtttatccattcaagttatctcatttatcttctaactttcctttcgttcacgaaaatgaagaagaactccaaagcttaaagaaagatttgaaatcatttagacttgggatgagtgagatttccaacaactacttatgtgtggaaagtccaatacaaattgctagatgggttccatgggaccatattttaaaggctaccaatccaaacggtaatttaagttatgatgcaacctctacattaacattacctgggcatgagttacctttaccaaaattgggtgtttcagccatcaagcttaaatccttaatgaattcaaccaaggaatcgatttctttaccagttgctcgtgaatgtaataccatcgtattatgtgactctagtgtaagtacaacggacagacccgaattattgagattaactggtggttctaagacctgtcaaccgagctggattcactctcagcacgaattaaatccacaagattcaattgttcaagggatctttcaattagctactttggccaaggataagaggttcggtctattattaaaggaaacgcagccaatgaagcagaagagtgttgagacatcaaatggcggagttgaagaaaccatgaaaatgtag

SEQ ID NO: 18 - protein, 593 aa, Saccharomyces cerevisiae
MALAISHEDTQILLKDKNILQESVLNKYRTAGQIAQTALKYVTSLINDSYHSKTTQRQLTVPELCLLTDSFILTRLEQYYKNKVNERGIAIPTTIDIDQISGGWCPEIDDTQNLLNWNKGKDSTFASSVTGTLRPGDLVKITLGVHIDGYTSEVSHTMVIYPVDETKPILQPTGPLLGGKADAVAAAHIAMETVVALLACALTPEKLPASLGGTSSGITGQLIRTIVDTIARSYNCGVVPGSRVRRIRRFLAGQNEGIVAEREYKGVVWTESHQEADLLSNTDAKDLTVVDRGQSTPFTNVSAIPSDDFVVQSGEVYLIDLKMASLEHCTKKGLVTLETVDSYTGKSHKAGELIARPGAYVRDFAQTHILKLKTSRQLLTKIDKQGVYPFKLSHLSSNFPFVHENEEELQSLKKDLKSFRLGMSEISNNYLCVESPIQIARWVPWDHILKATNPNGNLSYDATSTLTLPGHELPLPKLGVSAIKLKSLMNSTKESISLPVARECNTIVLCDSSVSTTDRPELLRLTGGSKTCQPSWIHSQHELNPQDSIVQGIFQLATLAKDKRFGLLLKETQPMKQKSVETSNGGVEETMKM

SEQ ID NO: 19 - DNA, 2097 bp, Saccharomyces cerevisiae
  CDS (1)..(2097)
atggttttttcttatgagcactatatgaatctccttttccatttggataacagtaaagaaacggtgcctccagagattgcaaaaagaataatttcaaatgctatagctcctgtaataacagttacttcaactcctctcttcgacaaacatattcaagaaacgtacaaagtagattctctctatatgctgctgcgattctttggcggttgtgtctctgatagagatcaagccaatgaagcgaaggttggacagcatgagcatgaggtttgtgatgcaagtgactcgacggattcaattcccaaaaataaaaatttggaagtgcccaatttatcaaagaaaggtagtcgcagtaggtcgaatagtcttttccagagggattcaacgcaatctcaatatatcaggtttacaaggccattaggtgacttgatcgaaacaagagatgcaaatgatatgttattcaattaccattctttagaggtattcttagataattatttgaaattggttgcagcaaatactgatgaaatggttcctcataatcttcttaagaaatccatttatcatagtttcttttcactagcaatttcatccacaaataacttatcgccctatgaaacttttaatcaccctattctttccttgattgctttagatatatcaaatggcgaagtttatgaggatgcaagagatcttttagtcaatttcaagaatcttaatcataatactgaaaactttcctatcttcatgaatacaaatgaaatgcttccagttttcttactctgctacaatgacgattcccaagaagaattcgaaaaatgccaggcgttagctaagaaactaaagaagcagttgtttgttgagagtatcttactagcactctggaaggattcttttatttacgacgaaaattcagtcatacagttacaccaaccagtaatgtcatcgcttgaagaaattctcttcttccttcaagctccaactcaaacaacactctctctggctttgataaactcgatctatgatatgcttgattatttggtttatgatttaatgataccattcatgaaaagaaaagtgtcattctgggaagagacaattttacagccaagaaagtcgctatttaatggtgcaaagtttttcaaaaaatttatgaataaaaatcctgtcaatggtaatcaccaacataattctctaacgagagacagccagggaaatgaatacttcgcatcgtcatcttctgagtttttgatgagaaagttagcagattggtctatgatgctatccgacttcaaaactgcttattccacatacgaatcgcttatggatgacctagatgcatttccaaagtacctggcatcatgcatcgaatggtgcgcggtatcactattgatgggtgcgcagagcatagtcaccgtgaaaatgatcaaaaacgatataaatcctcttatcgaaagggcattagccacatacgaaaactgctcacgaatacaacgtggtaaaggcaaagaatcaaactctttggatgttacagagccagtgcgttcgtatgagacacgttgtatgattttggcatctgaattgtttttatctttaagcaatacgtggacatctaccccatacgctatccaatatttagaaacaattctagacgagtgcaagttgggaccttgttcacagataatggtttgggaaaggcttagtgactgctataatttgagagttgaccctagaatcaaacatagagttggagcaatgaagaaggacgctaaagacaccgaagatctccgaggtgagcataagtatagcacagatcatttcacagacgaggacatattatcggaagggttaacaagaagacgcaaggcagctttttttaggttaatagcagctaagaagtgggcagagcaaaaacaatggagacaggtttcttggtgcttaaaagatattgaaagtacctattcagagatcaaatttttgcatggtaacggtttaattttaagcaaactaaaaaatcaactcaatttaaaggacgtggattctgcaccacggccctccgaaaagaatcttacaagaacaagtgttagctttattggatga

SEQ ID NO: 20 - protein, 698 aa, Saccharomyces cerevisiae
MVFSYEHYMNLLFHLDNSKETVPPEIAKRIISNAIAPVITVTSTPLFDKHIQETYKVDSLYMLLRFFGGCVSDRDQANEAKVGQHEHEVCDASDSTDSIPKNKNLEVPNLSKKGSRSRSNSLFQRDSTQSQYIRFTRPLGDLIETRDANDMLFNYHSLEVFLDNYLKLVAANTDEMVPHNLLKKSIYHSFFSLAISSTNNLSPYETFNHPILSLIALDISNGEVYEDARDLLVNFKNLNHNTENFPIFMNTNEMLPVFLLCYNDDSQEEFEKCQALAKKLKKQLFVESILLALWKDSFIYDENSVIQLHQPVMSSLEEILFFLQAPTQTTLSLALINSIYDMLDYLVYDLMIPFMKRKVSFWEETILQPRKSLFNGAKFFKKFMNKNPVNGNHQHNSLTRDSQGNEYFASSSSEFLMRKLADWSMMLSDFKTAYSTYESLMDDLDAFPKYLASCIEWCAVSLLMGAQSIVTVKMIKNDINPLIERALATYENCSRIQRGKGKESNSLDVTEPVRSYETRCMILASELFLSLSNTWTSTPYAIQYLETILDECKLGPCSQIMVWERLSDCYNLRVDPRIKHRVGAMKKDAKDTEDLRGEHKYSTDHFTDEDILSEGLTRRRKAAFFRLIAAKKWAEQKQWRQVSWCLKDIESTYSEIKFLHGNGLILSKLKNQLNLKDVDSAPRPSEKNLTRTSVSFIG

SEQ ID NO: 21 - DNA, 327 bp, Saccharomyces cerevisiae
  CDS (1)..(327)
atgcgatatactgcaacttttcggcctttgcaacgatttgtaatgaatccttttgcatcgctagaaggacaagataatatttcttctgttttttttttacatatgcaacaatttgaaagtcaggtcaaagacagattccggttccccatattcagattggagagaaaaacttttggcaactcatgttaccaagtcgagacgcttaaagttaagtgtcggccaagacacgcaaaatcttgtaatcttttaacgctgctcttcaaatcacggacgcaatcagtacttgtacctaattttggttttctaatattgaatagcgaaccatag

SEQ ID NO: 22 - protein, 108 aa, Saccharomyces cerevisiae
MRYTATFRPLQRFVMNPFASLEGQDNISSVFFLHMQQFESQVKDRFRFPIFRLERKTFGNSCYQVETLKVKCRPRHAKSCNLLTLLFKSRTQSVLVPNFGFLILNSEP

SEQ ID NO: 23 - DNA, 411 bp, Saccharomyces cerevisiae
  CDS (1)..(411)
atgcaattctctaccgtcgcttctatcgctgctattgccgctgttgcctccgccgcttctaacattaccactgctactgtcacagaagaatctaccactttggtcactatcacttcttgtgaggaccacgtttgttctgaaacagtttccccagctttggtttccactgctaccgtcaccgtaaatgacgttatcacttaatacaccacctggtgtccattgccaaccactgaagcaccaaagaataccacttctccagctccaactgaaaagccaaccgaaaagccaactgaaaagccaacccaacaaggttctagcactcaaactgttacctcctacactggtgccgctgttaaggctttgccagctgccggtgctttgttggctggtgctgccgctttattgttgtaa

SEQ ID NO: 24 - protein, 66 aa, Saccharomyces cerevisiae
MQFSTVASIAAIAAVASAASNITTATVTEESTTLVTITSCEDHVCSETVSPALVSTATVTVNDVIT

SEQ ID NO: 25 - protein, 69 aa, Saccharomyces cerevisiae
YTTWCPLPTTEAPKNTTSPAPTEKPTEKPTEKPTQQGSSTQTVTSYTGAAVKALPAAGALLAGAAALLL

SEQ ID NO: 26 - DNA, 693 bp, Saccharomyces cerevisiae
  CDS (1)..(693)
atggaaatgactgattttgaactaactagtaattcgcaatcgaacttggctatccctaccaacttcaagtcgactctgcctccaaggaaaagagccaagacaaaagaggaaaaggaacagcgaaggatcgagcgtattttgagaaacagaagagctgctcaccagagcagagagaaaaaaagactacatctgcagtatctcgagagaaaatgttctcttttggaaaatttactgaacagcgtcaaccttgaaaaactggctgaccacgaagacgcgttgacttgcagccacgacgcttttgttgcttctcttgacgagtacagggatttccagagcacgaggggcgcttcactggacaccagggccagttcgcactcgtcgtctgatacgttcacaccttcacctctgaactgtacaatggagcctgcgactttgtcgcccaagagtatgcgcgattccgcgtcggaccaagagacttcatgggagctgcagatgtttaagacggaaaatgtaccagagtcgacgacgctacctgccgtagacaacaacaatttgtttgatgcggtggcctcgccgttggcagacccactctgcgacgatatagcgggaaacagtctaccctttgacaattcaattgatcttgacaattggcgtaatccagccgtgattacgatgaccaggaaactacagtga

SEQ ID NO: 27 - protein, 230 aa, Saccharomyces cerevisiae
MEMTDFELTSNSQSNLAIPTNFKSTLPPRKRAKTKEEKEQRRIERILRNRRAAHQSREKKRLHLQYLERKCSLLENLLNSVNLEKLADHEDALTCSHDAFVASLDEYRDFQSTRGASLDTRASSHSSSDTFTPSPLNCTMEPATLSPKSMRDSASDQETSWELQMFKTENVPESTTLPAVDNNNLFDAVASPLADPLCDDIAGNSLPFDNSIDLDNWRNPAVITMTRKLQ

SEQ ID NO: 28 - DNA, 1398 bp, Saccharomyces cerevisiae
  CDS (1)..(1398)
atggcccgcaatagacaagcgtgcgactgttgttgcattcgtcgagtaaagtgtgatcgtaaaaaaccatgtaaatgttgtcttcaacacaatctgcaatgtacatatcttcgacctttgaagaaaagaggtccaaaacccgtcaaggtgagaaatttaaagaaagtagatgatgtacaggtatttagtaaaagtagtagtggtggcataatgaaggttccaaaggcactaattgatcagtgtctgcggctctataatgataagttgtatgtgatctggcctttgctgtgttatgatgatctttacgaacttttagagaaaagatatgacgaaacctgtgtgtattggttcctggtatctctttctgccgccacgcttagcgatttgcagactgaaattgagtcggaaggaggggttacctttactgggatacagttatccagtttctgcatgtcatcacgccaagaatttgacgattttaacggtagtgatatattcaagattatgacgtactattgtctaaaccgctgctacgcacagatgtccaactcaagaacttcgtatcggctttcttgtgaagccgtggggctcattaagttggcggggttccatcgcgaggaaactttgaaacttcttcctttcgatgagcagcagcttggaaggaaagtttattatttgcttctcttaacggaaagatacttttctgtgtatacgcattgcgccacgagcctggataccacgattgctccaccacaaccggagaacgtaacggacccccgactatctctcgacagcttcttggagatgattagggtatttactgtaccgggaaaatgcttctttgatgctctagctaccgactctgctaatgtaacctgtactgaagactcccttaaaaagatatggagggaacttcatacggtgccacttgagatagaaccatggtcttacggctatgtagacatatctttttcacggcattggattagaacacttgcttggaagctagtgcttcaaataagcggtatgcgaatcagtttcctttcaaatagcaagaatacgcatattccagtagaaattgctagagacatgttagaagacacatttttaatcccaaaaaatctttatgcagttcacggtccagggatatcagtgaaagcactagaaatagccgacgcattggtagatgttgtgaatcagtacgatcaaaatgcagagtcggaggcttggaattttttgttcgatatatccaaatttgtcttctctcttaagcattgtgatagcacattagttgataagtttacgacaaagtgtcagtgtgcgcttatcacgcttcctctttctaatccgcttgaatcgacagatggttctaaagaagatgtagatgcgcttccttaa

SEQ ID NO: 29 - protein, 465 aa, Saccharomyces cerevisiae
MARNRQACDCCCIRRVKCDRKKPCKCCLQHNLQCTYLRPLKKRGPKPVKVRNLKKVDDVQVFSKSSSGGIMKVPKALIDQCLRLYNDKLYVIWPLLCYDDLYELLEKRYDETCVYWFLVSLSAATLSDLQTEIESEGGVTFTGIQLSSFCMSSRQEFDDFNGSDIFKIMTYYCLNRCYAQMSNSRTSYRLSCEAVGLIKLAGFHREETLKLLPFDEQQLGRKVYYLLLLTERYFSVYTHCATSLDTTIAPPQPENVTDPRLSLDSFLEMIRVFTVPGKCFFDALATDSANVTCTEDSLKKIWRELHTVPLEIEPWSYGYVDISFSRHWIRTLAWKLVLQISGMRISFLSNSKNTHIPVEIARDMLEDTFLIPKNLYAVHGPGISVKALEIADALVDVVNQYDQNAESEAWNFLFDISKFVFSLKHCDSTLVDKFTTKCQCALITLPLSNPLESTDGSKEDVDALP

SEQ ID NO: 30 - DNA, 2025 bp, Saccharomyces cerevisiae
  CDS (1)..(2025)
atgtcggatgtagataactgggaacccgtatcagataatgaggacagtactgattctgtgaaacaattgggtcccccctttgagcatgcaagtaacaatgacaatgccggcgatactgaagctgagtcactgcaagaagtgcccctaaatacagagaccaacgacgtacgcaagaatttagtagtgattacaaaccaaagtgccgccgatgaacaccctacagagatcaagcacgatcaatcaaggacttcttcgacgtcctcgttcttcagtggaatgatctcttcgtttaagtcaaacgtgccatccccagtttctagatcaactacgccaacttcgccagtttcgcaaccaagcattatatcacatagaagggagccttccatggggtccaaaagaagatcaagccgccgtatcagtaatgccacaattgctgaaataggctctcccttgcaacaggtggaaaagcctgatgaggtcaagacaagactcactccttcccaaatgaaagaagacaattacgatcatagacgattcgtggaagaacgttacatggacacaccttatcactatgcgtctgagcaaagaaataaagactttcatgagacattcaagtccgttcctaaagatgacagactactggatgattttaattgtgggctgaatagagagctgctttaccaggggaaactatacataacagaaacgcatctctgcttcaactccaatgttcttggttggattgctaaagtactgattgcgttcgaagatgtcacgtttatggaaaaaacttctgctgctgggttgttccccagcgcaatatccatcgaaacaaagatgggcaaaactctctttaatggttttatatccagggatgctgcatttggattaatgaaagaagtgtggtcaagaaccttgttgcagaaggacatggccagcgaaaacatcaatactaaagcagaaaagtcaggaaatggcaaagagattgatgatgcaataaactccatcgatgaggaaaacaatgataaagacgctaatgataatgacactaatgaaaatgacgatgaaaatatctctacaaatgagactacccccaatagtacgagttcctcgccggataaagaaaaagagaaagcgtataaactgcgtgccgattcctcgtatcagtatgatggtccaatatatcatcattcaacaagctttccggctgaacctatggccaataacgagtttgttctcaaggagttaccattcgattgtgcacctggtatactttttgagatcatgttcaactcagagcaaaacgaatttcttctagattttttacggggtcaagaaggttcacaaattaccactattccaaatttcacgagcattgacggatcttccatgactttgaagcgtgagtattcatacgagaaagcattgcactttcctgcggggcccaagtccacgacatgttatgttgctgaggtaataaagagaaaagatcctgatacttactatgaggttatcagtagcatacgcactccgaacgtgcccagtggtggtagtttctcaactaagacaaggtatctaatccgttggaatgacgaaataacgtgtctgttacgggtatccttttgggtggaatggactggttccagttggatcaaaggtatggttgaaaatggatgcaagaatggtcaattggaggctgcgcaattaatggagcgtattctttccaagttcatcaagaacaatgtcgaagagtgccaaattactatcagcaaggaggaagaggagcaagatgataaagaagtaaaaaataagttgaaagaggttgaccttgaacaaccaagagaagcggttgttacggctcccgcaattgcagagcagcaaggtctcaaggtcaccatggaaacatggttgttcttatacttgattgtggtcgttttgctattgtttaatctgttctacatacgttcaattgctgtctcattacatcaactggtgaagctgcaattggtagaactgaagttgtga

SEQ ID NO: 31 - protein, 674 aa, Saccharomyces cerevisiae
MSDVDNWEPVSDNEDSTDSVKQLGPPFEHASNNDNAGDTEAESLQEVPLNTETNDVRKNLVVITNQSAADEHPTEIKHDQSRTSSTSSFFSGMISSFKSNVPSPVSRSTTPTSPVSQPSIISHRREPSMGSKRRSSRRISNATIAEIGSPLQQVEKPDEVKTRLTPSQMKEDNYDHRRFVEERYMDTPYHYASEQRNKDFHETFKSVPKDDRLLDDFNCGLNRELLYQGKLYITETHLCFNSNVLGWIAKVLIAFEDVTFMEKTSAAGLFPSAISIETKMGKTLFNGFISRDAAFGLMKEVWSRTLLQKDMASENINTKAEKSGNGKEIDDAINSIDEENNDKDANDNDTNENDDENISTNETTPNSTSSSPDKEKEKAYKLRADSSYQYDGPIYHHSTSFPAEPMANNEFVLKELPFDCAPGILFEIMFNSEQNEFLLDFLRGQEGSQITTIPNFTSIDGSSMTLKREYSYEKALHFPAGPKSTTCYVAEVIKRKDPDTYYEVISSIRTPNVPSGGSFSTKTRYLIRWNDEITCLLRVSFWVEWTGSSWIKGMVENGCKNGQLEAAQLMERILSKFIKNNVEECQITISKEEEEQDDKEVKNKLKEVDLEQPREAVVTAPAIAEQQGLKVTMETWLFLYLIVVVLLLFNLFYIRSIAVSLHQLVKLQLVELKL

SEQ ID NO: 32 - DNA, 1185 bp, Saccharomyces cerevisiae
  CDS (1)..(1185)
atgcctccaaagaagcaagtcgaagaaaaaaaggtcttattgggtcgtccaggtaataacttgaaagccggtattgtcggtttggccaatgttggtaagtctacctttttccaagccatcactagatgtccattgggtaacccagctaactatccattcgctaccattgatccagaagaagcccgtgttattgtcccatctccaagatttgataagttgtgtgaaatctacaagaagacagcttcggaagttccagctcatttgaccgtttacgatattgctggtttgactaagggtgcctctgctggtgaaggtttgggtaatgctttcttgtctcacatcagatcagtcgattctatctaccaagtcgttcgttgtttcgatgatgctgaaattatccacgttgagggtgacgttgatccagttcgtgatttagaaattattaaccaagaactaagattgaaagatattgaattcgcacaaaaggctttggaaggtgctgaaaagattgccaaaagaggtggtcaatctttggaagtcaaacaaaagaaggaagaaatggatttgattacgaaaatcattaaattgctagagagtggtcaaagagttgctaatcactcctggacttcaaaagaagttgaaattatcaactccatgttcttgttgactgctaagccatgtatctatttgattaatttatctgaaagagattacatcagaaagaaaaacaagcatctgctaagaatcaaggaatgggtagacaagtactctccaggtgacttgatcattccattcagtgtttctctagaagaaagactatctcatatgtccccagaagatgctgaagaagaattgaagaaactgcagacaatatctgccttgccaaagattatcactaccatgagacaaaagttagatttgatttcctttttcacctgcggtccagatgaagttcgtgaatggaccatcagaagaggtactaaagctccacaagctgctggtgttattcataacgatttaatgaatacctttattttggctcaagttatgaaatgtgaagatgtcttcgaatataaggacgattctgccatcaaggccgctggtaagttgatgcaaaagggtaaagactatgtcgttgaagacggtgatatcatttacttcagagctggtgctggtaagaattga

SEQ ID NO: 33 - protein, 394 aa, Saccharomyces cerevisiae
MPPKKQVEEKKVLLGRPGNNLKAGIVGLANVGKSTFFQAITRCPLGNPANYPFATIDPEEARVIVPSPRFDKLCEIYKKTASEVPAHLTVYDIAGLTKGASAGEGLGNAFLSHIRSVDSIYQVVRCFDDAEIIHVEGDVDPVRDLEIINQELRLKDIEFAQKALEGAEKIAKRGGQSLEVKQKKEEMDLITKIIKLLESGQRVANHSWTSKEVEIINSMFLLTAKPCIYLINLSERDYIRKKNKHLLRIKEWVDKYSPGDLIIPFSVSLEERLSHMSPEDAEEELKKLQTISALPKIITTMRQKLDLISFFTCGPDEVREWTIRRGTKAPQAAGVIHNDLMNTFILAQVMKCEDVFEYKDDSAIKAAGKLMQKGKDYVVEDGDIIYFRAGAGKN

SEQ ID NO: 34 - DNA, 735 bp, Saccharomyces cerevisiae
  CDS (1)..(735)
atgactgtggttgaaataaaaagccaggaccaatttacgcaactaaccactacaaacgctgctaataaactcattgtcttatattttaaagctcaatgggctgatccttgcaaaactatgagccaggtgctagaagctgttagtgaaaaagttaggcaagaggatgtccggtttttatcaatagatgcagacgaacatccagaaatatcagacctttttgagattgcagccgtaccatacttcgtcttcattcaaaatggtactattgtaaaagaaatatcagccgcagatcctaaggagtttgtgaaaagcttagaaattctttcgaatgcttctgcctcactagcgaacaatgccaagggtcctaaatctacgtctgatgaggaaagcagcgggtcttccgatgatgaagaggacgaaactgaagaagaaataaatgctaggctggtgaagctagtacaagctgcacctgtgatgctattcatgaaaggaagcccatcagaacctaaatgcggattttctagacagttagttggtatcctcagagaacaccaaataaggttcggattttttgatatattaagagacgaaaacgttagacaaagcttgaagaagttttctgattggcctacttttcctcagttatatatcaatggggagttccagggaggtttggatattatcaaggaatctatagaagaagatcctgaatatttccaacatgctctacagtaa

SEQ ID NO: 35 - protein, 244 aa, Saccharomyces cerevisiae
MTVVEIKSQDQFTQLTTTNAANKLIVLYFKAQWADPCKTMSQVLEAVSEKVRQEDVRFLSIDADEHPEISDLFEIAAVPYFVFIQNGTIVKEISAADPKEFVKSLEILSNASASLANNAKGPKSTSDEESSGSSDDEEDETEEEINARLVKLVQAAPVMLFMKGSPSEPKCGFSRQLVGILREHQIRFGFFDILRDENVRQSLKKFSDWPTFPQLYINGEFQGGLDIIKESIEEDPEYFQHALQ

SEQ ID NO: 36 - DNA, 351 bp, Saccharomyces cerevisiae
  CDS (1)..(351)
atgcacattcttttcttgtttattttccactgtttggcattcaaagacttgattttttttaagcaatacgtaccatttgcagcggcgggaggatatcccatatcgtttctattcatcaaagttctgaccgcctcaacgaatttactactttcttcttcctctggagggtcctggaataagttatccaaagagtcgcaattactcaaagtcattctcacacactttcttgttcctattttttttttcttattccaatatattattttatcagaagacagacagcaagaacgacagcctaagtttcgagacaacgctaaatttgacggacatgcgaagacatgccatatataa

SEQ ID NO: 37 - protein, 116 aa, Saccharomyces cerevisiae
MHILFLFIFHCLAFKDLIFFKQYVPFAAAGGYPISFLFIKVLTASTNLLLSSSSGGSWNKLSKESQLLKVILTHFLVPIFFFLFQYIILSEDRQQERQPKFRDNAKFDGHAKTCHI

SEQ ID NO: 38 - DNA, 900 bp, Saccharomyces cerevisiae
  CDS (1)..(900)
atgtctaccttttctgcttctgatttcaactcagaaagatattcatcttcaagaccttcttatccctccgatttttacaagatgattgatgaataccacgacggagaaaggaaattactcgtagatgttggctgtggaccaggtactgccactttacaaatggctcaggagttaaaaccattcgaacaaattatcggaagcgatctctccgctaccatgattaagactgcagaagtaataaaggaaggaagtcctgatacatacaaaaacgtttcatttaagatttcttcaagtgatgattttaaattcctaggcgcggattcagtagacaaacagaaaattgatatgattaccgcagtagaatgtgctcattggttcgatttcgaaaaatttcagcgatctgcttatgccaatttgagaaaagatggtactatcgctatttggggttatgcggacccaattttcccggactaccctgaatttgatgatctgatgattgaagttccttacgggaagcaaggactgggaccctattgggaacaaccggggagatctcgccttcgtaatatgctgaaagactctcacttagacccagaacttttccatgatatacaagtttcatatttttgtgcagaagatgtgagagacaaagtaaaactccaccagcatacaaagaagccattgctaatcagaaagcaggtcaccctagtggagtttgcagattatgtcagaacctggagcgcttaccatcagtggaagcaggatccaaagaacaaagataaagaagatgtagcagattggtttattaaagagtcactaaggaggaggccggaactttccaccaacaccaaaattgaagttgtttggaatactttttacaaacttggcaaaagggtctga

SEQ ID NO: 39 - protein, 299 aa, Saccharomyces cerevisiae
MSTFSASDFNSERYSSSRPSYPSDFYKMIDEYHDGERKLLVDVGCGPGTATLQMAQELKPFEQIIGSDLSATMIKTAEVIKEGSPDTYKNVSFKISSSDDFKFLGADSVDKQKIDMITAVECAHWFDFEKFQRSAYANLRKDGTIAIWGYADPIFPDYPEFDDLMIEVPYGKQGLGPYWEQPGRSRLRNMLKDSHLDPELFHDIQVSYFCAEDVRDKVKLHQHTKKPLLIRKQVTLVEFADYVRTWSAYHQWKQDPKNKDKEDVADWFIKESLRRRPELSTNTKIEVVWNTFYKLGKRV

SEQ ID NO: 40 - DNA, 336 bp, Saccharomyces cerevisiae
  CDS (1)..(336)
atgaaaggttcaaaatcgcaccttgtcttcactctcctgcaagtatcacaactaaatgtttttcttttctttctaggttttttgttgccattattcttaggactgttcgtttcactgcgctctttggctcttgcactatcctctgggtggtttattatggatctgatactatttcgcacctttccagaagcagaattatatccagcagtcatcggtaaaccatctggtctggggcttactgaggcatttgagtttatatccatttttttccctgatgttcagcaaaccgaaagaaatataaaatacaactgggaaagatgttttaatggtgagtaa

SEQ ID NO: 41 - protein, 111 aa, Saccharomyces cerevisiae
MKGSKSHLVFTLLQVSQLNVFLFFLGFLLPLFLGLFVSLRSLALALSSGWFIMDLILFRTFPEAELYPAVIGKPSGLGLTEAFEFISIFFPDVQQTERNIKYNWERCFNGE

SEQ ID NO: 42 - DNA, 2556 bp, Saccharomyces cerevisiae
  CDS (1)..(2556)
atgccgaagaatagtcaccaccatcgttccagttcggttaattccacaaagagtcgttctacggaatctacgaataaatggaaaattccgcactattatcgcagatccgctagcggcagcacacaagcttcgccggacaggaactcctcaacaggctcatgtagcactccagtattacctactatgaatgttatgtctagcccgaaaaaagttttgctagaggatcccagagacaaccatactaaggcgaagaagagtagtagaaagaaatcaggtgaaatggtcttcgtcaattatactgtacaggacacggctaacgaaaatgatactgacttgcaaacccagccggtttctgtgccagcaccaaaggcgaaattaaagaagaaatcctccaaaaggagaatgctgaagatatttggatcgtcaaagaacgaacacatagaggacatcgttgaagagcaaccaatggtgcttcaaatggattcagaatctaaacccctttcgggaacccctatctcagaaagcggaatcgacgcctcgtcactaacaaccaaaagatcttataactcgttcttaaaacacaataggctaaacggtaaaactccgttctctggaaacttgtcctttccatcattaaacatgatgggtaacactactgatctgcctattgacaataacgatttttgttccgagaaagaagtcgttccgaaatcaactcatgatccttcactagcaaaaccgccatcaaggttcactgaaagcgaaacaaattctactcccaacttatcaagtatacctctcatgaacacaaaaaatacaagattgaagtacaataaagtggcgcctcagagttcagaccgacaaaagtcacaggaaagtgggctatatcattctaccgaatcattcaacttcaaagatcaaaactacagtaacaataaatcctctttaagtctgaactccgatttaagtacaccccactttgcaaagcattcacctgattcaccaagaacttcaagatctttcaactgcggagactcacaaagtaaagttaaattaccggaagaaaatgacgcttctattgcatttagtaagatgtttactagaaaacgagccaacactggcgggtccacgtgttcgctagcctcacccactattgcacaaactattcagcaatcaaatataaaagttaataaattgccaactcagcgaaccacttcagttggctcattatcatccatgtcaaatcgttattcaccaataagagttgcatcgccaggaagagcaagatccgcaactcgtgggtcttccctttatagattatccagagaccttaattctttaccaagcgtcactgatctaccagaaatggatagtacaaccccagttaacgaaatattcttggatggccaaccacagcataaaagtggcagtgtcaaaggagggcataggaagaaacaagaatctatctctgatgctcaaagaattcaacattctaattcgtacattacaacaccttcatcttctctggtgactcctccttactacatgacaggttacacattaccaagttctgcatctgcttcttcaactccaaatgtgcttgaaacacacaatatgaactttgttccaagtaccagtactgttacaagttatcgcccatctagcaatttttcctcatttgacaaagaatacagtaacgaaaacgacgctagtggggaattctctgctttcaatactccaatggagaatataccggcactaaaaggtatacctagatccacgttagaagaaaatgaagaagaggatgtcctagtacaagatattccgaatacggcacacttccaaagaagggatattatggggatggatactcacagaaaggatgacagtttagattttaactctttgatgccacacggtagtacaactagtagcagcatcgtagattctgttatgacgaactcaatatccactacaacaagcaacgcgaccggaaactactttcaagatcaagataagtatacattggtaaatacgggattgggattgagtgatgcaaacctcgatcattttattagatctcaatggaaacacgcttctcgatcagaatccaataataataccggaaatcgcgtttcttacagtggctcaacaccaaacaatgttgatacaacaaagactaatttgcaagtgtataccgagttcgattttgaaaacccagagtcgtttttccatgagcaatcgaagctactaggtgagatgggccacagcaataacaacagcaacagcgccatcaacatgaatgaacccaagtctgcggatacatacattggaaatatatctccggatacttcagcaactgtttcattaggcgacctgatgggctcaaacgtttcaaacaacagtgaaagaaatttttacgatggtcatactttcgttccacagtatcaggcgaactcatctgtggaaaactcaaataatcaaaatgcagcaccaattgcaaataacgacattgataataatttacagtctttttattttgataatagcaactaa

SEQ ID NO: 43 - protein, 851 aa, Saccharomyces cerevisiae
MPKNSHHHRSSSVNSTKSRSTESTNKWKIPHYYRRSASGSTQASPDRNSSTGSCSTPVLPTMNVMSSPKKVLLEDPRDNHTKAKKSSRKKSGEMVFVNYTVQDTANENDTDLQTQPVSVPAPKAKLKKKSSKRRMLKIFGSSKNEHIEDIVEEQPMVLQMDSESKPLSGTPISESGIDASSLTTKRSYNSFLKHNRLNGKTPFSGNLSFPSLNMMGNTTDLPIDNNDFCSEKEVVPKSTHDPSLAKPPSRFTESETNSTPNLSSIPLMNTKNTRLKYNKVAPQSSDRQKSQESGLYHSTESFNFKDQNYSNNKSSLSLNSDLSTPHFAKHSPDSPRTSRSFNCGDSQSKVKLPEENDASIAFSKMFTRKRANTGGSTCSLASPTIAQTIQQSNIKVNKLPTQRTTSVGSLSSMSNRYSPIRVASPGRARSATRGSSLYRLSRDLNSLPSVTDLPEMDSTTPVNEIFLDGQPQHKSGSVKGGHRKKQESISDAQRIQHSNSYITTPSSSLVTPPYYMTGYTLPSSASASSTPNVLETHNMNFVPSTSTVTSYRPSSNFSSFDKEYSNENDASGEFSAFNTPMENIPALKGIPRSTLEENEEEDVLVQDIPNTAHFQRRDIMGMDTHRKDDSLDFNSLMPHGSTTSSSIVDSVMTNSISTTTSNATGNYFQDQDKYTLVNTGLGLSDANLDHFIRSQWKHASRSESNNNTGNRVSYSGSTPNNVDTTKTNLQVYTEFDFENPESFFHEQSKLLGEMGHSNNNSNSAINMNEPKSADTYIGNISPDTSATVSLGDLMGSNVSNNSERNFYDGHTFVPQYQANSSVENSNNQNAAPIANNDIDNNLQSFYFDNSN

SEQ ID NO: 44 - DNA, 1575 bp, Saccharomyces cerevisiae
  CDS (1)..(1575)
atgtcccaacgatcttcacaacacattgtaggtattcattatgctgtaggacctaagattggcgaagggtctttcggagtaatatttgagggagagaacattcttcattcttgtcaagcgcagaccggtagcaagagggactctagtataataatggcgaacgagccagtcgcaattaaattcgaaccgcgacattcggacgcaccccagttgcgtgacgaatttagagcctataggatattgaatggctgcgttggaattccccatgcttattattttggtcaagaaggtatgcacaacatcttgattatcgatttactagggccatcattggaagatctctttgagtggtgtggtagaaaattttcagtgaaaacaacctgtatggttgccaagcaaatgattgatagagttagagcaattcatgatcacgacttaatctatcgcgatattaaacccgataactttttaatttctcaatatcaaagaatttcacctgaaggaaaagtcattaaatcatgtgcctcctcttctaataatgatcccaatttaatatacatggttgactttggtatggcaaaacaatatagagatccaagaacgaaacaacatataccataccgtgaacgaaaatcattgagcggtaccgccagatatatgtctattaatactcattttggaagagaacagtcacgtagggatgatttagaatcgctaggtcacgtttttttttatttcttgaggggatccttgccatggcaaggtttgaaagcaccaaacaacaaactgaagtatgaaaagattggtatgactaaacagaaattgaatcctgatgatcttttattgaataatgctattccttatcagtttgccacatatttaaaatatgcacgttccttgaagttcgacgaagatccggattatgactatttaatctcgttaatggatgacgctttgagattaaacgacttaaaggatgatggacactatgactggatggatttgaatggtggtaaaggctggaatatcaagattaatagaagagctaacttgcatggttacggaaatccaaatccaagagtcaatggcaatactgcaagaaacaatgtgaatacgaattcaaagacacgaaatacaacgccagttgcgacacctaagcaacaagctcaaaacagttataacaaggacaattcgaaatccagaatttcttcgaacccgcagagctttactaaacaacaacacgtcttgaaaaaaatcgaacccaatagtaaatatattcctgaaacacattcaaatcttcaacggccaattaaaagtcaaagtcaaacgtacgactccatcagtcatacacaaaattcaccatttgtaccatattcaagttctaaagctaaccctaaaagaagtaataatgagcacaacttaccaaaccactacacaaaccttgcaaataagaatatcaattatcaaagtcaacgaaattacgaacaagaaaatgatgcttattctgatgacgagaatgatacattttgttctaaaatatacaaatattgttgttgctgtttttgttgctgttga

SEQ ID NO: 45 - protein, 524 aa, Saccharomyces cerevisiae
MSQRSSQHIVGIHYAVGPKIGEGSFGVIFEGENILHSCQAQTGSKRDSSIIMANEPVAIKFEPRHSDAPQLRDEFRAYRILNGCVGIPHAYYFGQEGMHNILIIDLLGPSLEDLFEWCGRKFSVKTTCMVAKQMIDRVRAIHDHDLIYRDIKPDNFLISQYQRISPEGKVIKSCASSSNNDPNLIYMVDFGMAKQYRDPRTKQHIPYRERKSLSGTARYMSINTHFGREQSRRDDLESLGHVFFYFLRGSLPWQGLKAPNNKLKYEKIGMTKQKLNPDDLLLNNAIPYQFATYLKYARSLKFDEDPDYDYLISLMDDALRLNDLKDDGHYDWMDLNGGKGWNIKINRRANLHGYGNPNPRVNGNTARNNVNTNSKTRNTTPVATPKQQAQNSYNKDNSKSRISSNPQSFTKQQHVLKKIEPNSKYIPETHSNLQRPIKSQSQTYDSISHTQNSPFVPYSSSKANPKRSNNEHNLPNHYTNLANKNINYQSQRNYEQENDAYSDDENDTFCSKIYKYCCCCFCCC

SEQ ID NO: 46 - DNA, 1125 bp, Saccharomyces cerevisiae
  CDS (1)..(1125)
atgaggatacagtcgctttttgttttatttaatgttgccatcatcgcatggtcatatccatatgagcctttaagggttttacaagtaggagagaatgaggtaatggaggttcccgaatcagaaaagctaaacttacgaagaagaggtgtcaaattctttgatgtgaccaaacacacttctttcttacctttctttaacaaggaggaagagccaacagtaccaacgtataactatcctcctgagatatcgaacaaagaagtagtggatgattcgattaagaatatagacaagggctctatgcacaagaacttggcaaagtttacaagtttttacacccgttactacaagtccgatcacggctttgaatctgccgagtggttagctgcaactatcgctaatattacaaaagatattccgcaagatacgttgactattgaacattttgatcacaaagaatggaagcaatattcaattatagtccgtgtcacgggatctactacgccagaagatattataataattggttctcatcaagattctatcaatctgctactgccatccataatggcagctccaggtgcggacgacaatgggtcaggcacggtgactaatatggaggctctcagattatatacggaaaattttttgaagagaggatttagacctaacaacactgtggaatttcacttttattccgccgaagaggggggattgttgggttctcttgatgtttttacagcttatgccaaacagaaaaagcatgtgagagcgatgcttcagcaagacatgacgggatatgtttctgatccagaagatgaacatgtggggattgtcaccgactacactactcccgcattaactgattttataaaactaattatcaactcttatctatccattccttacagggatacacaatgtggctatgcttgtagcgatcatgggagtgccaccagaaacggatttccaggctccttcgtgattgaaagtgagttcaaaaagactaacaagtatattcacagcaccatggatactttggacagattaagtctcgctcatatggcggaacacacaaaaattgtattaggggtaatcattgaactcgggtcatggtccgcttggtaa

SEQ ID NO: 47 - protein, 374 aa, Saccharomyces cerevisiae
MRIQSLFVLFNVAIIAWSYPYEPLRVLQVGENEVMEVPESEKLNLRRRGVKFFDVTKHTSFLPFFNKEEEPTVPTYNYPPEISNKEVVDDSIKNIDKGSMHKNLAKFTSFYTRYYKSDHGFESAEWLAATIANITKDIPQDTLTIEHFDHKEWKQYSIIVRVTGSTTPEDIIIIGSHQDSINLLLPSIMAAPGADDNGSGTVTNMEALRLYTENFLKRGFRPNNTVEFHFYSAEEGGLLGSLDVFTAYAKQKKHVRAMLQQDMTGYVSDPEDEHVGIVTDYTTPALTDFIKLIINSYLSIPYRDTQCGYACSDHGSATRNGFPGSFVIESEFKKTNKYIHSTMDTLDRLSLAHMAEHTKIVLGVIIELGSWSAW

SEQ ID NO: 48 - DNA, 1530 bp, Saccharomyces cerevisiae
  CDS (1)..(1530)
atgatcgctttgaagcccaatgctgttcgaaccttccgacaagtgcagcattgcagctttcgcatttgtcggtatcaatctacgaagtcaaataagtgtctgacgcccttgcaagagtacgacagactggtgaagttggggaagctacgggatgatacatatcagcgtggtatcatctcttccttaggggatttgtatgattcactggttaaatatgtacctccggttgtcaagacacccaatgctgtcgaccaagttggcggttggttgaatggtcttaaatccgtatttagccgtggcaaacctaagaacattggggcgtatgtggatgtatccaaaattggtaactcgatacctcgaggagtttacctatatggagatgttggctgcggaaagacaatgttgatggaccttttttatactacaattcccaatcatttaacaaaaaagagaatacattttcaccagtttatgcaatatgttcacaaaaggtcgcatgaaattgttagagagcaaaatttgaaagaactaggtgatgcaaaaggaaaagagatcgatacggttccatttttggccgcagagattgcaaataattcgcatgttctttgttttgacgagtttcaagtcactgacgtggcagatgcaatgatattgagaaggctgatgactgccttactatccgatgattatggtgtcgtacttttcgcaacctcgaatagacatccagatgagttgtatatcaacggtgttcaaagacaatcatttattccttgtattgaactgataaagcatagaactaaggttatcttcttgaattcgccaacagattaccgtaagattccaagacctgtgtcctcagtttactatttcccatccgatacgagcataaaatacgcatcaaaggaatgtaaaacccgtcgagaaactcatattaaggaatggtataactatttcgcacaggcttcccacaccgatgattccactgattcacacacggtgcataagacattttatgattatccattaactatttgggggagagagttcaaagtccctaagtgtaccccacctcgagtcgcgcagtttactttcaagcagttgtgtggtgagcctttggccgcaggagattacttgacgttggcaaaaaattttgaagcctttatagtgaccgatattccatatttgtccatttacgttcgtgatgaagtgagaagatttattacatttttagatgctgtatatgacagtggcgggaaactggccactacgggtgcagcggatttttcttccttgtttgtggaacctgaacagatacttaatgattttgagttacgcccaacaaccaaagaacctgatagcgtcgatactggtatggtagatgagatggttgagaaacacggtttttcgaaagagattgccaagaaatcgcagatgtttgctcttgatgaagaaagatttgcctttgcccgtgccttaagcaggctgtcacagatgagctccaccgattgggttactaagcctacatactaa

SEQ ID NO: 49 - protein, 509 aa, Saccharomyces cerevisiae
MIALKPNAVRTFRQVQHCSFRICRYQSTKSNKCLTPLQEYDRLVKLGKLRDDTYQRGIISSLGDLYDSLVKYVPPVVKTPNAVDQVGGWLNGLKSVFSRGKPKNIGAYVDVSKIGNSIPRGVYLYGDVGCGKTMLMDLFYTTIPNHLTKKRIHFHQFMQYVHKRSHEIVREQNLKELGDAKGKEIDTVPFLAAEIANNSHVLCFDEFQVTDVADAMILRRLMTALLSDDYGVVLFATSNRHPDELYINGVQRQSFIPCIELIKHRTKVIFLNSPTDYRKIPRPVSSVYYFPSDTSIKYASKECKTRRETHIKEWYNYFAQASHTDDSTDSHTVHKTFYDYPLTIWGREFKVPKCTPPRVAQFTFKQLCGEPLAAGDYLTLAKNFEAFIVTDIPYLSIYVRDEVRRFITFLDAVYDSGGKLATTGAADFSSLFVEPEQILNDFELRPTTKEPDSVDTGMVDEMVEKHGFSKEIAKKSQMFALDEERFAFARALSRLSQMSSTDWVTKPTY

SEQ ID NO: 50 - DNA, 1710 bp, Saccharomyces cerevisiae
  CDS (1)..(1710)
atgaaggatttaaaattatcgaatttcaaaggcaaatttataagcagaaccagtcactggggacttacgggtaagaagttgcggtatttcatcactatcgcatctatgacgggcttctccctgtttggatacgaccaagggttgatggcaagtctaattactggtaaacagttcaactatgaatttccagcaaccaaagaaaatggcgatcatgacagacacgcaactgtagtgcagggcgctacaacctcctgttatgaattaggttgtttcgcaggttctctattcgttatgttctgcggtgaaagaattggtagaaaaccattaatcctgatgggttccgtaataaccatcattggtgccgttatttctacatgcgcatttcgtggttactgggcattaggccagtttatcatcggaagagtcgtcaccggtgttggaacagggttgaatacatctactattcccgtttggcaatcagaaatgtcaaaagctgaaaatagagggttgctggtcaatttagaaggttccacaattgcttttggtactatgattgcttattggattgattttgggttgtcttataccaacagttctgttcagtggagattccccgtgtcaatgcaaatcgtttttgctctcttcctgcttgctttcatgattaaactacctgaatcgccacgttggctgatttctcaaagtcgaacagaagaagctcgctacttggtaggaacactagacgacgcggatccaaatgatgaggaagttataacagaagttgctatgcttcacgatgctgttaacaggaccaaacacgagaaacattcactgtcaagtttgttctccagaggcaggtcccaaaatcttcagagggctttgattgcagcttcaacgcaatttttccagcaatttactggttgtaacgctgccatatactactctactgtattattcaacaaaacaattaaattagactatagattatcaatgatcataggtggggtcttcgcaacaatctacgccttatctactattggttcattttttctaattgaaaagctaggtagacgtaagctgtttttattaggtgccacaggtcaagcagtttcattcacaattacatttgcatgcttggtcaaagaaaataaagaaaacgcaagaggtgctgccgtcggcttatttttgttcattacattctttggtttgtctttgctatcattaccatggatatacccaccagaaattgcatcaatgaaagttcgtgcatcaacaaacgctttctccacatgtactaattggttgtgtaactttgcggttgtcatgttcaccccaatatttattggacagtccggttggggttgctacttattttttgctgttatgaattatttatacattccagttatcttctttttctaccctgaaaccgccggaagaagtttggaggaaatcgacatcatctttgctaaagcatacgaggatggcactcaaccatggagagttgctaaccatttgcccaagttatccctacaagaagtcgaagatcatgccaatgcattgggctcttatgacgacgaaatggaaaaagaggactttggtgaagatagagtagaagacacctataaccaaattaacggcgataattcgtctagttcttcaaacatcaaaaatgaagatacagtgaacgataaagcaaattttgagggttga

SEQ ID NO: 51 - protein, 569 aa, Saccharomyces cerevisiae
MKDLKLSNFKGKFISRTSHWGLTGKKLRYFITIASMTGFSLFGYDQGLMASLITGKQFNYEFPATKENGDHDRHATVVQGATTSCYELGCFAGSLFVMFCGERIGRKPLILMGSVITIIGAVISTCAFRGYWALGQFIIGRVVTGVGTGLNTSTIPVWQSEMSKAENRGLLVNLEGSTIAFGTMIAYWIDFGLSYTNSSVQWRFPVSMQIVFALFLLAFMIKLPESPRWLISQSRTEEARYLVGTLDDADPNDEEVITEVAMLHDAVNRTKHEKHSLSSLFSRGRSQNLQRALIAASTQFFQQFTGCNAAIYYSTVLFNKTIKLDYRLSMIIGGVFATIYALSTIGSFFLIEKLGRRKLFLLGATGQAVSFTITFACLVKENKENARGAAVGLFLFITFFGLSLLSLPWIYPPEIASMKVRASTNAFSTCTNWLCNFAVVMFTPIFIGQSGWGCYLFFAVMNYLYIPVIFFFYPETAGRSLEEIDIIFAKAYEDGTQPWRVANHLPKLSLQEVEDHANALGSYDDEMEKEDFGEDRVEDTYNQINGDNSSSSSNIKNEDTVNDKANFEG

SEQ ID NO: 52 - DNA, 432 bp, Saccharomyces cerevisiae
  CDS (1)..(432)
atggagaccaatttttccttcgactcgaatttaattgttattatcattatcacgttgtttgccacaagaattattgctaaaagatttttatctactccaaaaatggtatcccaggaaacagttgctcacgtaaaggatctgattggccaaaaggaagtgtttgttgcagcaaagacatactgcccttactgtaaagctactttgtctaccctcttccaagaattgaacgttcccaaatccaaggcccttgtgttggaattagatgaaatgagcaatggctcagagattcaagacgctttagaagaaatctcgggccaaaaaactgtacctaacgtatacatcaatggcaagcacattggtggtaacagcgatttggaaactttgaagaaaaatggcaagttagctgaaatattgaagccggtatttcaatag

SEQ ID NO: 53 - protein, 143 aa, Saccharomyces cerevisiae
METNFSFDSNLIVIIIITLFATRIIAKRFLSTPKMVSQETVAHVKDLIGQKEVFVAAKTYCPYCKATLSTLFQELNVPKSKALVLELDEMSNGSEIQDALEEISGQKTVPNVYINGKHIGGNSDLETLKKNGKLAEILKPVFQ

SEQ ID NO: 54 - DNA, 426 bp, Saccharomyces cerevisiae
  CDS (1)..(426)
atgaaatgtcacgcgaaacggacccttgcctttttggcgacggcacttcccctatctggaaaaagccgagcatgcacccgtaccccacaaagcttcgcttccggtttccgggcagcagcgccgtttcttttttcccgctgcttcgccctttgtattactcattgcgcactttttcacttgccatattcgttcaccggtttttctttttatttcttcgtcttttttcgtctttttcttcactggatatacgctttttgcatttgcaatagcacatatgtgtatatatataagcaagtgttgagcttgcctgtcaaatcctccatgtgtccttctcgtctatcttgttctgtctggtatagagtaatacttacatacatatacgtacattgtttccgctggctagttcgtaaccacctcctttcctag

SEQ ID NO: 55 - protein, 141 aa, Saccharomyces cerevisiae
MKCHAKRTLAFLATALPLSGKSRACTRTPQSFASGFRAAAPFLFSRCFALCITHCALFHLPYSFTGFSFYFFVFFRLFLHWIYAFCICNSTYVYIYKQVLSLPVKSSMCPSRLSCSVWYRVILTYIYVHCFRWLVRNHLLS

SEQ ID NO: 56 - DNA, 1488 bp, Saccharomyces cerevisiae
  CDS (1)..(1488)
atgaaaactgatagattactgattaacgcttccccggagacatgtaccaagggagatgctgagatggatactatggatactattgacagaatgacatcagttaaagttttagcggaaggcaaggtattaagcaacttcgaagaaccgggcttaatgaggtgcggttatcatgatgcaaaaaactgggtcagaagattatcgagcgaaacaattgtcggtgaggacacgagtaatttatacccattttatgttgatactgcatacgatgtaaggcgtttgagaaaggatcttataaatgctaaggttgacttgcaggttgaaaacctgataataatctgcaatattaatgatatttccactgtatttctcatgagagaagtggtggaatggatcttacgcaatttccattcaataactgtatatgtacaagatatttttaaaaagtcaactcagtttgctgttggtgacctctgcaaagacagcaattgcagtaaaaacagagtaaagtattggtcaaaagaatttgttaaaaaacacgattcattctttgacttgatgattacactagggggtgatggaactgtcctttttgcttcatctatattcacgaaagatgttccgccgattgttccatttgcccttggatcattaggatttctaacaaattttgaatttcaaaatttcaaagaaacgttgaaacatatcttaacagatgaggttcgtattaatttacgaatgaggttgcaatgcaaactctaccgtagaaataaaccagaaattgatgccgcaactgggagaaaaatatgttacatcgatttcatctccgaacatcacgtattgaacgaagtaaccatagatagaggtccagctccttgtttatccctattagaactctatggaaacgactcactaatgactaaggttcagggagatggattgattgttgccacgcctacgggatccacggcatactcattgagtgcaggaggctctttaatatcgccaagcgtaaatgccatagcggtgacgcctatatgtcctcatactttgagctttaggcctataattttaccagatagcatggaattaaaagttagagtagatatgaactcaagagggacgtcgtgggtgaattttgacggaaaagatagagttgaattgaaacagggtgactatgttgtgataactgcaagcccctattcggtaccgactatcgagtcatctgccagtgaattttttgaaagtatcagtaaaaatcttaattggaatgaccgcgaagagcagaagccatttgcacatattctctcgccaaaaaatcaagaaaaatatagattagactcatcgaaaaatggaaacgacaccataagtaatcccctcgagagttcatgcataagctcagatgcacaagatgaggagaggaaatccgtaacggaaacagaaacagaaatagttgttgaacggactcgtcaggctcattttgcaatctaa

SEQ ID NO: 57 - protein, 495 aa, Saccharomyces cerevisiae
MKTDRLLINASPETCTKGDAEMDTMDTIDRMTSVKVLAEGKVLSNFEEPGLMRCGYHDAKNWVRRLSSETIVGEDTSNLYPFYVDTAYDVRRLRKDLINAKVDLQVENLIIICNINDISTVFLMREVVEWILRNFHSITVYVQDIFKKSTQFAVGDLCKDSNCSKNRVKYWSKEFVKKHDSFFDLMITLGGDGTVLFASSIFTKDVPPIVPFALGSLGFLTNFEFQNFKETLKHILTDEVRINLRMRLQCKLYRRNKPEIDAATGRKICYIDFISEHHVLNEVTIDRGPAPCLSLLELYGNDSLMTKVQGDGLIVATPTGSTAYSLSAGGSLISPSVNAIAVTPICPHTLSFRPIILPDSMELKVRVDMNSRGTSWVNFDGKDRVELKQGDYVVITASPYSVPTIESSASEFFESISKNLNWNDREEQKPFAHILSPKNQEKYRLDSSKNGNDTISNPLESSCISSDAQDEERKSVTETETEIVVERTRQAHFAI

SEQ ID NO: 58 - DNA, 1125 bp, Saccharomyces cerevisiae; identical to SEQ ID NO: 46
  CDS (1)..(1125)

SEQ ID NO: 59 - protein, 374 aa, Saccharomyces cerevisiae; identical to SEQ ID NO: 47

SEQ ID NO: 60 - DNA, 1470 bp, Saccharomyces cerevisiae
  CDS (1)..(1470)
atgacaaaaagtgatttattatttgataaattcaacgacaaacatggaaagtttctagttttttttggtacctttgtagatacccctaaattaggagagctgagaatcagagagaaaacatctgttggagttctcaacggaatcatcaggtttgtgaacagaaattcactcgatcctgtcaaagattgtttagatcacgatagtagcttatcaccagaggatgtcacggtggttgacataattggaaaagacaagactcgaaataacagcttttattttccaggttttgttgacacgcataaccatgtctcgcaatatccaaatgtcggcgtatttgggaattctaccctgctggattggctagagaagtataccttccccatagaagccgcactagcaaacgaaaatattgcgagagaagtttacaataaggtaataagtaagacgctttctcacggtacaacgactgtggcttactataataccattgatctcaagtccactaagctcttggctcaactaagctccttattggggcagcgtgttcttgttggaaaagtgtgcatggataccaatggtcccgagtattatattgaagatactaaaacttcctttgaaagcactgtgaaagttgttaagtacatacgggaaaccatttgtgatcccctcgtaaatcctatagtgacaccaaggttcgcgccctcttgttctagagaactaatgcaacagttgtccaagctagtcaaggatgaaaacatacacgttcaaacccacttgtcggaaaataaggaggagatacagtgggttcaagatttatttcccgaatgtgagagctatactgatgtatacgacaaatatgggctgctcacagaaaaaacagtattggcacattgtattcatctaacagatgccgaagcgcgtgtgattaaacagcgtcgctgtggtatatctcattgtcccatttccaactcctctctgacttctggagagtgtagggttcgatggttgctggaccagggcataaaggttggtctaggcaccgacgtttcagccggtcattcttgtagcatactcaccaccggaaggcaggcctttgcagtttcaaggcatttggcaatgagagaaactgatcatgcaaaactttcagtctccgagtgcctatttcttgctacaatgggcggagcacaagtcttgcgtatggatgagaccttggggacttttgacgtcggtaagcagtttgacgctcaaatgatcgataccaatgctcccggctcaaacgtggatatgtttcattggcagctaaaggagaaggatcaaatgcaagagcaagagcaagagcaagggcaagacccttataagaacccaccgctgcttactaatgaagacataatcgcaaaatggttctttaacggtgatgatcgcaacaccactaaagtttgggtagccggccagcaagtctaccagatttag

SEQ ID NO: 61 - protein, 489 aa, Saccharomyces cerevisiae
MTKSDLLFDKFNDKHGKFLVFFGTFVDTPKLGELRIREKTSVGVLNGIIRFVNRNSLDPVKDCLDHDSSLSPEDVTVVDIIGKDKTRNNSFYFPGFVDTHNHVSQYPNVGVFGNSTLLDWLEKYTFPIEAALANENIAREVYNKVISKTLSHGTTTVAYYNTIDLKSTKLLAQLSSLLGQRVLVGKVCMDTNGPEYYIEDTKTSFESTVKVVKYIRETICDPLVNPIVTPRFAPSCSRELMQQLSKLVKDENIHVQTHLSENKEEIQWVQDLFPECESYTDVYDKYGLLTEKTVLAHCIHLTDAEARVIKQRRCGISHCPISNSSLTSGECRVRWLLDQGIKVGLGTDVSAGHSCSILTTGRQAFAVSRHLAMRETDHAKLSVSECLFLATMGGAQVLRMDETLGTFDVGKQFDAQMIDTNAPGSNVDMFHWQLKEKDQMQEQEQEQGQDPYKNPPLLTNEDIIAKWFFNGDDRNTTKVWVAGQQVYQI

SEQ ID NO: 62 - DNA, 441 bp, Saccharomyces cerevisiae
  CDS (1)..(441)
atgaaaggctcacccatttctcaatttagtaagacctctattaatgctcttaccaggccttggaagaaatacagagatggtgaattattttatgggttatcaaaagttgggaataaaagagtgccgttgaccacgaagcaaggtaacaagacgatgtacaaagggacaagagcttcagggattggtagacatacaaaattcggtggttatgtgataaactggaagaaagtcagaacctatgttaccccagatatggttaatttcgaattaaagccctacgttaacgcaaatgtaccacctctaaaacacgaatttaaaggatttagcggcggcccattagatcctcgtttacagttattaaagataaaagaatacatagtaaacgggagggtacaaagcgaaggggccaccgacacttcatgttataaggagcgtggataa

SEQ ID NO: 63 - protein, 146 aa, Saccharomyces cerevisiae
MKGSPISQFSKTSINALTRPWKKYRDGELFYGLSKVGNKRVPLTTKQGNKTMYKGTRASGIGRHTKFGGYVINWKKVRTYVTPDMVNFELKPYVNANVPPLKHEFKGFSGGPLDPRLQLLKIKEYIVNGRVQSEGATDTSCYKERG

SEQ ID NO: 64 - DNA, 429 bp, Saccharomyces cerevisiae
  CDS (1)..(429)
atggcgtataatcaagaagatagtaaaagactatcagacaagtataagaaggagggacattttgacaagttgaaaagagaaatattgtctaacccatggaataatacagaagagaatagtgaatcttttgaacaagcgcttcggaaaagagttgccagtactgttaaagaaatggttaacgaagatgaagaattaatatttaaaaacagagggctaaccagtgcattgattgaatcacaattggtcaaggacaactacctaaagctgggtagtaaaatggagggggataatggtgatggtgagaagaaatttgacttggatgtctatgtacggtctaagttacaggatcccaaactattggaaatgataaagggacaacttcaggaaacactgaactcttatgaagaggaagcaaatggaagtacgtaa

SEQ ID NO: 65 - protein, 142 aa, Saccharomyces cerevisiae
MAYNQEDSKRLSDKYKKEGHFDKLKREILSNPWNNTEENSESFEQALRKRVASTVKEMVNEDEELIFKNRGLTSALIESQLVKDNYLKLGSKMEGDNGDGEKKFDLDVYVRSKLQDPKLLEMIKGQLQETLNSYEEEANGST

SEQ ID NO: 66 - DNA, 462 bp, Saccharomyces cerevisiae
  CDS (1)..(462)
atgacctttttacaatttatcaataataatagacaagaaggacaaggttatatttcagaaaaattattcaaaactaagaagaatgagatgataagaaaaacagttaccaatttagtagctgtaagattaaaaaacttatcccacgaatttgatgtaatagagaattatctgcgctatatagctagcaccagtgaacatctatttactgctattaagcgccactttaacaaatgtgccagaaaacttttgaaagaagcaatcgactccaaatcaaactcagaaactgctacggtggttctgcaagaaggattttctggcatttgcttattgaaagcgtcttcaattatattaaaactaaaattgaagtttccaaaaaagaaagatagaactgatattagcaaattgtgtgacaagaaagaacggatgacacagtggttagaaatttcaattttgatgaactga

SEQ ID NO: 67 - protein, 153 aa, Saccharomyces cerevisiae
MTFLQFINNNRQEGQGYISEKLFKTKKNEMIRKTVTNLVAVRLKNLSHEFDVIENYLRYIASTSEHLFTAIKRHFNKCARKLLKEAIDSKSNSETATVVLQEGFSGICLLKASSIILKLKLKFPKKKDRTDISKLCDKKERMTQWLEISILMN

SEQ ID NO: 68 - DNA, 1584 bp, Saccharomyces cerevisiae
  CDS (1)..(1584)
atgagtctctcgcaggtgtcacctttaccccatatcaaggatgttgttttaggagatacagtaggccaaggcgcattcgcctgcgttaaaaatgctcatcttcaaatggatccctccattattctagctgttaaattcattcatgttcccacttgcaaaaaaatgggactcagtgacaaggatatcacaaaagaggttgttttgcaatcgaagtgttctaagcatcctaatgttttgagacttatcgattgtaatgtctctaaagaatatatgtggataattctggagatggcagatggtggtgatctatttgataagattgagcctgacgttggagttgattccgacgtggcccaattttactttcaacagctcgttagtgctattaattatctgcatgtagaatgtggagttgctcacagagacatcaagcctgaaaacatcttactcgataagaacggaaatctgaagctagctgattttgggctcgcctctcaatttaggaggaaagatggtacattacgtgtatccatggatcaaaggggttctccaccctacatggctcctgaagtattatattctgaagagggttattacgcagatcgaacagatatatggtctattggcatcctcttgttcgtattgttgactggtcaaacgccttgggaattaccttcattagagaacgaagatttcgtcttttttattgaaaatgatggaaatttaaactggggaccctggtcaaagatagaatttactcacttgaacctactccgaaaaattttacaacctgacccaaataagagggtgacattgaaggctttaaagttacatccttgggtattacgtcgagcttcattttctggggatgatggtctctgtaatgaccctgaactcttggctaagaaactgttttctcacttaaaagtctcactgagtaacgaaaattatttgaaattcactcaagatacaaactctaataataggtacatttctactcagccaattggtaacgaattggctgagcttgaacacgactcaatgcatttccagacagtttcgaatacacaacgtgcatttacctcgtatgattcaaatacgaactataatagcggaacaggtatgacacaagaggctaagtggacgcaattcataagctatgatatcgctgccttacagtttcattctgatgaaaatgattgtaatgaattagtaaaacgacatttacaatttaatccgaataaacttaccaagttctacacgttgcaacctatggatgttttgttaccgattttggagaaagccttgaatttatcacaaattagagtaaaacccgacctttttgcgaattttgaaagattgtgcgaattattgggttatgataacgttttcccacttattataaatattaaaaccaaaagtaatgggggttatcaattatgcggtagcatttccatcataaagattgaagaagagttgaaaagtgtcggatttgaaagaaaaactggtgatcctttagaatggagaagattgttcaagaaaatttcaactatctgtagggatattatcctaattcccaactga

SEQ ID NO: 69 - protein, 527 aa, Saccharomyces cerevisiae
MSLSQVSPLPHIKDVVLGDTVGQGAFACVKNAHLQMDPSIILAVKFIHVPTCKKMGLSDKDITKEVVLQSKCSKHPNVLRLIDCNVSKEYMWIILEMADGGDLFDKIEPDVGVDSDVAQFYFQQLVSAINYLHVECGVAHRDIKPENILLDKNGNLKLADFGLASQFRRKDGTLRVSMDQRGSPPYMAPEVLYSEEGYYADRTDIWSIGILLFVLLTGQTPWELPSLENEDFVFFIENDGNLNWGPWSKIEFTHLNLLRKILQPDPNKRVTLKALKLHPWVLRRASFSGDDGLCNDPELLAKKLFSHLKVSLSNENYLKFTQDTNSNNRYISTQPIGNELAELEHDSMHFQTVSNTQRAFTSYDSNTNYNSGTGMTQEAKWTQFISYDIAALQFHSDENDCNELVKRHLQFNPNKLTKFYTLQPMDVLLPILEKALNLSQIRVKPDLFANFERLCELLGYDNVFPLIINIKTKSNGGYQLCGSISIIKIEEELKSVGFERKTGDPLEWRRLFKKISTICRDIILIPN

SEQ ID NO: 70 - DNA, 849 bp, Saccharomyces cerevisiae
  CDS (1)..(849)
atggatccaagtttagttttagagcaaacgatacaagatgtgtccaacctcccatcagaatttcgttacctcttagaggagatcggttcaaatgatttgaagctcatcgaagaaaaaaagaaatacgagcaaaaagaatcacaaatacacaaatttataagacagcaaggctcaataccgaaacatccacaggaagatgggcttgacaaagaaataaaagaatcacttttgaaatgtcagtctttgcaaagagaaaaatgcgttctggcgaacactgccttgtttctaattgctagacacttgaataagttggaaaaaaacatcgctttattggaggaagatggtgttctagcccccgtggaagaagatggagacatggatagcgctgctgaagcctctagagaaagttcagttgtgagtaacagtagcgtgaaaaagagaagagctgcatcaagctcaggatccgttccacccactttgaaaaagaaaaaaactagtcgaacatctaaactgcaaaatgaaattgacgtttcttcaagagaaaagtctgttactccagtgagcccaagcattgaaaagaagattgcaagaacaaaagaattcaaaaacagtagaaatggtaaaggccaaaacggttcccctgaaaacgaggaagaggacaaaactttatactgcttctgtcaaagagtttcgtttggagaaatggttgcatgtgatggacccaactgtaaatatgaatggtttcattatgattgtgtaaatttaaaagaacctccgaaaggaacatggtactgtcccgaatgtaaaattgagatggaaaaaaacaaactgaaaagaaaacgtaactga

SEQ ID NO: 71 - protein, 282 aa, Saccharomyces cerevisiae
MDPSLVLEQTIQDVSNLPSEFRYLLEEIGSNDLKLIEEKKKYEQKESQIHKFIRQQGSIPKHPQEDGLDKEIKESLLKCQSLQREKCVLANTALFLIARHLNKLEKNIALLEEDGVLAPVEEDGDMDSAAEASRESSVVSNSSVKKRRAASSSGSVPPTLKKKKTSRTSKLQNEIDVSSREKSVTPVSPSIEKKIARTKEFKNSRNGKGQNGSPENEEEDKTLYCFCQRVSFGEMVACDGPNCKYEWFHYDCVNLKEPPKGTWYCPECKIEMEKNKLKRKRN

SEQ ID NO: 72 - DNA, 1479 bp, Saccharomyces cerevisiae
  CDS (1)..(1479)
atggagagtcgaactacagggcctttaacgactgaaacctacgatggccccactgtggccttcatgatattaggtgccgccctagtattttttatggtgcccggattgggattcttgtactccggattggcaagaaggaagtctgcactagcactaatctgggttgtattaatggcgactttggtcggtatactgcaatggtatttctggggttactctctagctttttcaaagtccgctccgaataataaattcattgggaatctagattcgtttggctttagaaacgtgtacggaaaaaaattcgatgaagatgcctaccctgagctcgcgtatgcaaccttccaaatgatgttttcgtgcgtcaacttaagtattatcgctggcgccactgccgaaagaggcaggctgctaccgcacatggtttttctctttattctagctaccattggatattgtccagtgacgtattggatttggtcaccaggtggttgggcataccaatggggagtcctcgattgggcaggcggcggcaacattgaaatattaagcgctgtttccgggtttgtttactcttggtttttgggcaaaagaaatgaaaagttactgataaatttcaggcctcataatgtttcattggtcactctaggcacatccatactgtggtttggctggctgctatttaattctgcatcctcattatccccaaatttgaggtcagtttatgcattcatgaatacatgtctcagtgccattactggtgggatgacgtggtgtcttctggattacagatcggagaagaaatggtcgacagttggtctgtgctccggtatcatttctgggctggtggctgcaacgccaagctcaggctgtataaccctttacggttcacttattcaaggcattgtggcgggggtagtgtgtaactttgcgacgaagttgaaatactacgctaaagtagatgatgccatggacattctagctgagcacggggttgcaggcgtaataggactaattttcaatgccctttttggagcagactgggtcattggtatggatggcactacagagcacgagggcggctgggtaactcacaattacaagcaaatgtataagcagatcgcttacattgccgcatccattgggtacactgctgctgtaactgcaataatctgctttgtgctcggctacatacccggtatgaggctaagaatatcagaagaggcagaggaggcgggtatggacgaagatcaaattggcgaatttgcgtacgattatgtggaagtgagaagagattactatctatggggtgtagacgaagattcacaacgctctgatgtaaatcaccgggtgaacaacgctcatttggccgctgaacgtagcagtagcggtactaatagttcctcggatgggaatggagaaatgattcaatccgaaaagatcctaccaattcatcaagaagatcctgccaataggtaa

SEQ ID NO: 73 - protein, 492 aa, Saccharomyces cerevisiae
MESRTTGPLTTETYDGPTVAFMILGAALVFFMVPGLGFLYSGLARRKSALALIWVVLMATLVGILQWYFWGYSLAFSKSAPNNKFIGNLDSFGFRNVYGKKFDEDAYPELAYATFQMMFSCVNLSIIAGATAERGRLLPHMVFLFILATIGYCPVTYWIWSPGGWAYQWGVLDWAGGGNIEILSAVSGFVYSWFLGKRNEKLLINFRPHNVSLVTLGTSILWFGWLLFNSASSLSPNLRSVYAFMNTCLSAITGGMTWCLLDYRSEKKWSTVGLCSGIISGLVAATPSSGCITLYGSLIQGIVAGVVCNFATKLKYYAKVDDAMDILAEHGVAGVIGLIFNALFGADWVIGMDGTTEHEGGWVTHNYKQMYKQIAYIAASIGYTAAVTAIICFVLGYIPGMRLRISEEAEEAGMDEDQIGEFAYDYVEVRRDYYLWGVDEDSQRSDVNHRVNNAHLAAERSSSGTNSSSDGNGEMIQSEKILPIHQEDPANR

SEQ ID NO: 74 - DNA, 939 bp, Saccharomyces cerevisiae
  CDS (1)..(939)
atgtgcattttaatggccacaagggcacatcctgactatgaactcatcttaatatctaacagagacgaattcttggcaagaaaaacacatgctacatgctggcataacaatgattttatcctttcaccctacgatctggccaaaacctcagcagaaaaacaaatatttggcacttggtctggcataaataaagaaggaaaattagccactattcttaatttaaaacttgacaatgagcaaaataatacgaaatcaagatcccgtggtctgttaccatttatatttttgtcgatccataaagcagattttgaagattgggataattacaaaaagtttgaaggtcactatgatgggttgaagtccacaggtgattttaattttttttacggcgacgttatcaaaaagcaatataaagttattgattctctaggaagaacttttgatgtgttgagttctacctgtaggaaagatcttgattcttacatggttgtttctaatggtaaattttatgacagctccagtataccagggcaggcttgggaaaaagtaaaggtagcacgtgatagtttagaaaatctagttttagagaatattgaatcagatgaggagaaaataatatcaagttgctttcaactcgcctcgaagtcttcccttccaagcactatttcaaacccagatgtcttgcagatggtagatccaaatgtaaccatgaataccatatacgtaccacctttacggaggcctcccagggatgacttaggtgcctcaattcctgatggtgattactacggaactcgctctcaaatagttttactcgtgagtaaggattcaacgagagttacctttatagaaagggtcctttatagctcagatgaagacgtgcgcaagtattcggtaacctcacctaaggaggaaaaaaggtttaaattcaaattgtaa

SEQ ID NO: 75 - protein, 312 aa, Saccharomyces cerevisiae
MCILMATRAHPDYELILISNRDEFLARKTHATCWHNNDFILSPYDLAKTSAEKQIFGTWSGINKEGKLATILNLKLDNEQNNTKSRSRGLLPFIFLSIHKADFEDWDNYKKFEGHYDGLKSTGDFNFFYGDVIKKQYKVIDSLGRTFDVLSSTCRKDLDSYMVVSNGKFYDSSSIPGQAWEKVKVARDSLENLVLENIESDEEKIISSCFQLASKSSLPSTISNPDVLQMVDPNVTMNTIYVPPLRRPPRDDLGASIPDGDYYGTRSQIVLLVSKDSTRVTFIERVLYSSDEDVRKYSVTSPKEEKRFKFKL

SEQ ID NO: 76 - DNA, 2595 bp, Saccharomyces cerevisiae
  CDS (1)..(2595)
atgtacatggccagatgtggccccaagaataatgtgctgtgtttcccatttcaactttcctttctattttcaaaacgactaataaataagcgtttcaagtataccctacaaactgaagatgaaaagaatatgatggggagtttaagtaaaaataaaataataacacctgaagacgttgagttcaaattagcacaattacgagaattttctaatactttaaaagaacgcattcacaacactaaatcggtgaattcagatggccaccaaagcaatagtatcgcaccaatctcagaagactcaaggaatgttaatgtcaccaaaacatcatctgttcctaatgaagaaaaatccaaaaatctatcagatttgattcattcttcgtttttagaaaaaatggatcacctcgtaccaaaagttataagagaaagagtagcagacgacgacatacttgcaaaaaacctttttgatagatcacacagtaattgggcacctgtcatagataggctttatgtcagtgagaaacggttcatggatattgattccagagaattttctgtttggttaaatggtacagtcaaatatttgccatttcatagtatactacacttggatgaaatgctattagaacaaatcaatggagatgttgtaaaatttaatacccacatgtacgaatgtatctttaacaacttaggaaatttaaaaccaactaattttaatcaggatggtactaacgataaagttatcctcaaaatgaaagagttgttagagaggtatgataaggcattaaaaataactgaagaaagaattaacaaaaaagaaggattcccttccaaagtaccaaagatgacgcaagcaatacttaataattgtttaaaatactcgaccaagtgttcaagctttcacgacatggattattttattacaaaattcagagatgattatggcataactcctaataagcaaaacctaactactgtaatacaattctactctaggaaggaaatgactaagcaagcctggaatacttttgacaccatgaaatttttatctacaaagcatttccctgatatctgcacatataacacaatgctgcgaatatgcgagaaggaacggaattttcctaaggctttggatttatttcaagaaattcaagaccacaatataaagcctacaacaaacacttacataatgatggcaagagtgttggcttcttcgagcagtaatgccgttgtcagtgagggtaaatcagactctctaagattactgggatggaaataccttcatgagttggaggacaagaatctttacagacataaaaaagatgacttaaatttatttttggctatgatggcattagccgcgtttgatggtgatattgaattaagtagagctctatattacttgttcatcgcgaaaaagtacaaaactttgtgcgcaaattggaaaggaaacattctcgtagatcaagatacaatttggaagtcaactttaatgccagaaatgctgaattatttgatgcttgcttatgcaagatttgatcccagaaatttgccagtcttatccggttatgaaaaaggcattgaattgagaagaaaatttcttcgcgaatttgattcctccatgaggttagatgatacagacaaattggtcaaatttaaattaccatttcttccaattagtgacctaaattcggaggcacaagtattggcggaatctaacgcaatctggagtttcaatatggaaaatggaggaacgcgcaatacattgacatcttcaaatgaagcggcgttggaggatatcaaaaaatataggcaattacttgattcgtttgcgcaagaagcagaggatttcaacgagtttaagtttaaagttatgtacgaagtgacgaaaatgcaaagagaaagtattaatgtgaacgtcttcaataaaatttcactacacacatatttgtcaattcccattaacttaaaacaacagaaggaattcttgcgaaggttgacgttcttcactttccaacaacacgaatttgaagctgtcataaagcgtttgtatgaaggataccgtaatattccttcgtcccatacgcgtgaccaaaattcaatatcaactgaagccatctcagtatccaaacctgagaccacggaagacctcaacttaataatgcatgatatatggtatattacatgtttgaggcacaaaatcatgatggacaccacgttatatgagctggtgatgaaagccgctatagaatttcaaaatgaggacttagcaaagaaagtatggaatgataggggtaaatttaggacgactgtaccgtttctgaaaatggaccaaagaataagaatagcaaaggatcagaaatttgcccatctaatggttgaattcttcacaaagcaaggaaagtattcggacgcaatagctatcatattgtcttcaaaaaatcgcttcaattggacttattccatggttaggaatttgcataaagcattagaagaaatcgaggatagaaatagcgttgaaatcttactggatgtagtaaacaaaaagtcacacgcaaaggccctgaagtgggaggaacaagaacttaacatgtag

SEQ ID NO: 77 - protein, 864 aa, Saccharomyces cerevisiae
MYMARCGPKNNVLCFPFQLSFLFSKRLINKRFKYTLQTEDEKNMMGSLSKNKIITPEDVEFKLAQLREFSNTLKERIHNTKSVNSDGHQSNSIAPISEDSRNVNVTKTSSVPNEEKSKNLSDLIHSSFLEKMDHLVPKVIRERVADDDILAKNLFDRSHSNWAPVIDRLYVSEKRFMDIDSREFSVWLNGTVKYLPFHSILHLDEMLLEQINGDVVKFNTHMYECIFNNLGNLKPTNFNQDGTNDKVILKMKELLERYDKALKITEERINKKEGFPSKVPKMTQAILNNCLKYSTKCSSFHDMDYFITKFRDDYGITPNKQNLTTVIQFYSRKEMTKQAWNTFDTMKFLSTKHFPDICTYNTMLRICEKERNFPKALDLFQEIQDHNIKPTTNTYIMMARVLASSSSNAVVSEGKSDSLRLLGWKYLHELEDKNLYRHKKDDLNLFLAMMALAAFDGDIELSRALYYLFIAKKYKTLCANWKGNILVDQDTIWKSTLMPEMLNYLMLAYARFDPRNLPVLSGYEKGIELRRKFLREFDSSMRLDDTDKLVKFKLPFLPISDLNSEAQVLAESNAIWSFNMENGGTRNTLTSSNEAALEDIKKYRQLLDSFAQEAEDFNEFKFKVMYEVTKMQRESINVNVFNKISLHTYLSIPINLKQQKEFLRRLTFFTFQQHEFEAVIKRLYEGYRNIPSSHTRDQNSISTEAISVSKPETTEDLNLIMHDIWYITCLRHKIMMDTTLYELVMKAAIEFQNEDLAKKVWNDRGKFRTTVPFLKMDQRIRIAKDQKFAHLMVEFFTKQGKYSDAIAIILSSKNRFNWTYSMVRNLHKALEEIEDRNSVEILLDVVNKKSHAKALKWEEQELNM

SEQ ID NO: 78 - DNA, 357 bp, Saccharomyces cerevisiae
  CDS (1)..(357)
atgcagacaatgggcggggagcaccttcttctttcacagctaaaggggtctttctttctcctacttttggcatactttttcaggggcagaagtccttattacgcacgttgctaccgccggcttgctgttacacctggtgccatcactattgccattgccattgctacagattcaattccggcgcttgcaaagtccaaagttctggtgtcggtttgttctcacacagatccctgtacagcgtcttgtaacctgatccccttcccccgccccttctcgaacagcctgacgcgcttcctcttttgtttgggctcggcccgtttttgcatttcctttccctgttttggattgagtatataa

SEQ ID NO: 79 - protein, 118 aa, Saccharomyces cerevisiae
MQTMGGEHLLLSQLKGSFFLLLLAYFFRGRSPYYARCYRRLAVTPGAITIAIAIATDSIPALAKSKVLVSVCSHTDPCTASCNLIPFPRPFSNSLTRFLFCLGSARFCISFPCFGLSI

SEQ ID NO: 80 - DNA, 1062 bp, Saccharomyces cerevisiae
  CDS (1)..(1062)
atgattcaatttaaaagtccaggtaactggctgttcatagtaccctggattgccttcattccatggtatggtatgctgatagccatgcttatttgctgggccagtcaaggccatcccatatattggttcatgcactcggagcaattccctgtgtacatttcagatataggtgccactaatttaaggccactgtttatatcgtgcgccggctggcagggtctaggctatgtaatcactgttgcccttgagttttttcaaagatccggctatctgcctttccaactgaaaaaaaaagacccttctatctctgattccacatcttatgctgagaaattgcacagcggtaaatacttaatgcctccatattacacaaaggatgaacggaacctgattttcgcagcttttgttctcggcagcattggtgaactagcccttttattcagttccatcttctcaaccgccctgtaccatcgcgttcacattgctatggtctctgttttcgtcgtcttcatgttcctatccacttgctgcttgattgcagagtatttcctcatgggaaggcactatgcctcagtccaccccctagccagccctcatttcaatcctcaatcatctgaaaaaagctttaaccaagattataacactgtggatgagctgccttggtataaatggaaaggccatgtatggaataaatttaccatcagtgcaactctaaaagttatatggttaactctcgcagttgtatgggccatttgttttggtgctatcaatgatagatctaagagtgcttgtttcgaatggttgctagcattttggtttggtatcatatttatgattctttccgccgacttttatttaggtggaagatacagacaatcccgctatttcaaccacgtggaatcattttcgggttattacaagtatgacaaggcgctaggcctctaccacagtgaagacgttttgccttcggacgataacgccggcgtgattgccacagaaacagcatcttcaaatatttacaataattcctcttccaacgaatctattcaagtagtcgtatga

SEQ ID NO: 81 - protein, 353 aa, Saccharomyces cerevisiae
MIQFKSPGNWLFIVPWIAFIPWYGMLIAMLICWASQGHPIYWFMHSEQFPVYISDIGATNLRPLFISCAGWQGLGYVITVALEFFQRSGYLPFQLKKKDPSISDSTSYAEKLHSGKYLMPPYYTKDERNLIFAAFVLGSIGELALLFSSIFSTALYHRVHIAMVSVFVVFMFLSTCCLIAEYFLMGRHYASVHPLASPHFNPQSSEKSFNQDYNTVDELPWYKWKGHVWNKFTISATLKVIWLTLAVVWAICFGAINDRSKSACFEWLLAFWFGIIFMILSADFYLGGRYRQSRYFNHVESFSGYYKYDKALGLYHSEDVLPSDDNAGVIATETASSNIYNNSSSNESIQVVV

SEQ ID NO: 82 - DNA, 975 bp, Saccharomyces cerevisiae
  CDS (1)..(975)
atgtcatctgacaactctaaacaagataaacaaattgaaaaaacagccgcccagaagatatcgaagtttggttcgtttgtggctggtgggctagcagcatgtatagctgttacagttactaatccgatcgaattgattaaaatcagaatgcagcttcaaggtgaaatgtcagcatcagctgcaaaagtttataaaaatccaatccaaggtatggcggtaattttcaaaaacgaaggtataaaaggtctgcaaaaagggttaaatgctgcttatatctatcaaattgggctaaatggttccagattagggttttatgagccaatcagatcatcattaaatcagcttttcttcccagatcaagagccacataaggtacagagcgtcggagttaacgtcttttctggtgccgcatctggtataattggtgcagtcattggctctccattattcttggtgaaaacaagacttcaatcatattccgagtttataaaaattggtgaacaaacgcactacaccggtgtttggaacgggttagtaaccatttttaaaaccgaaggtgttaagggtctattcagaggtattgatgcggcaattttaaggacaggtgctggttcctctgttcaactacctatctacaacacagcaaagaacattttggtcaaaaatgatctgatgaaagatggcccagcattacatttaactgctagtactatctctgggttaggtgttgccgtcgttatgaacccatgggatgtcattttgacaagaatctataatcaaaaaggtgacttgtacaagggacctatagattgtttggtcaaaactgttagaatcgaaggtgtaaccgctttgtataagggttttgcagctcaagtgttcagaatcgcacctcatacaatcatgtgtttgaccttcatggaacagacaatgaaactagtttattcgatagagtcgagagttttaggccataattaa

SEQ ID NO: 83 - protein, 324 aa, Saccharomyces cerevisiae
MSSDNSKQDKQIEKTAAQKISKFGSFVAGGLAACIAVTVTNPIELIKIRMQLQGEMSASAAKVYKNPIQGMAVIFKNEGIKGLQKGLNAAYIYQIGLNGSRLGFYEPIRSSLNQLFFPDQEPHKVQSVGVNVFSGAASGIIGAVIGSPLFLVKTRLQSYSEFIKIGEQTHYTGVWNGLVTIFKTEGVKGLFRGIDAAILRTGAGSSVQLPIYNTAKNILVKNDLMKDGPALHLTASTISGLGVAVVMNPWDVILTRIYNQKGDLYKGPIDCLVKTVRIEGVTALYKGFAAQVFRIAPHTIMCLTFMEQTMKLVYSIESRVLGHN

SEQ ID NO: 84 - DNA, 1062 bp, Saccharomyces cerevisiae
  CDS (1)..(1062)
atgtcgacagcacagaaagctaagatattgcaactcatcgattcctgctgccaaaatgcaaaaagcacacaactgaaatctttatcatttgttattggagcagtaaatggcacgacgaaagaagctaaaagaacctacattcaagaacagtgtgaatttttggagaagttacgacaacaaaagataagagagggaagaattaacatattgtctatggatgctggtgtttctaactttgctttctctaagatgcaattgctcaataatgatccgctccctaaagtactagactggcaaaagataaatctagaggagaaattttttcaaaacctcaaaaagttaagcttgaatcctgctgaaacttctgagcttgtatttaaccttacggagtatttatttgaatctatgccgataccagatatgtttacaattgaaaggcaacgtaccagaactatgtcttcgaggcatattttagacccaattttaaaagtgaatattctcgaacagattcttttctctaacttggaaaataaaatgaagtatacgaataaaataccgaatacgtccaagttgaggtatatggtatgttcgtccgatccacatcggatgacttcatattggtgcattccaagagaagagacaccgaccagttcaaaaaagttaaaatctaacaaacatagcaaagattctcgaataaagctagtgaaaaaaatactttcaacctcaatactagaaggtaattcaactagttctacaaaactggtcgagttcataggagtttggaataataggataagaaatgcccttaccaaaaaaaaaagtttcaagctatgtgatatactagagatccaagataattcgggggtgagaaaagatgacgatttggcagattcattcctccattgtttgtcttggatggagtggttaaaaaattatgaaagtattactgaactcttgaattcaaaaacactggttaaaacacagttcggacaggtgtttgaattttgtgaaaataaggtacaaaagctgaaatttttgcagaacacttacaacaatgactaa

SEQ ID NO: 85 - protein, 353 aa, Saccharomyces cerevisiae
MSTAQKAKILQLIDSCCQNAKSTQLKSLSFVIGAVNGTTKEAKRTYIQEQCEFLEKLRQQKIREGRINILSMDAGVSNFAFSKMQLLNNDPLPKVLDWQKINLEEKFFQNLKKLSLNPAETSELVFNLTEYLFESMPIPDMFTIERQRTRTMSSRHILDPILKVNILEQILFSNLENKMKYTNKIPNTSKLRYMVCSSDPHRMTSYWCIPREETPTSSKKLKSNKHSKDSRIKLVKKILSTSILEGNSTSSTKLVEFIGVWNNRIRNALTKKKSFKLCDILEIQDNSGVRKDDDLADSFLHCLSWMEWLKNYESITELLNSKTLVKTQFGQVFEFCENKVQKLKFLQNTYNND

SEQ ID NO: 86 - DNA, 2052 bp, Saccharomyces cerevisiae
  CDS (1)..(2052)
atgaacaaagaattggcttctaagtttttatcaagcatcaagcatgaacgtgaacaagacattcaaacaacttctaggctattaacaacgctatctatccaacaattggtgcaaaatggcttggcaataaacaacatacatctagaaaacataagatccggtctcattggcaaattatatatggaactgggacctaacttggcggttaacgacaaaattcaaaggggtgatattaaggttggtgatattgttttggtacgccctgcaaaaaccaaagtaaataccaagactaagcccaaagtcaaaaaggtgtctgaagactccaatggcgagcaagcggaatgctcaggcgttgtctacaaaatgagtgatactcaaatcaccatagctctagaagaatctcaagatgttattgctaccacattttattcttatagcaaactttacattttaaagactaccaatgtcgtcacgtataatagaatggaatccacaatgagaaaactgtctgaaattagttcacccatacaagacaaaattatacaatacttggtaaacgaacgccccttcatccccaatacaaacagctttcaaaacattaaatcttttttaaacccgaatctgaatgactcccagaaaactgccattaattttgccattaacaatgacttgaccattatacatggtcctcctggtacgggtaaaacattcacattaattgaattgatccagcaattgctaattaaaaatcctgaggagagaatcttaatttgtgggccttccaatatttctgtggatacgattctggagaggctaacgcctcttgtgccgaataatttattattaagaatcggtcatcctgctaggctattagactctaataaaagacactctcttgatatacttagtaaaaagaatactattgtgaaggacatttcccaggagattgacaaattaattcaggagaataaaaaactaaaaaactataagcaacgtaaagaaaactggaacgaaattaaactgctgcgcaaagatttaaagaaaagagagttcaaaaccattaaggacttaataatacaatcgagaatagtcgtcaccactttacacggttcatcatcgagagaactatgctccctttatagagatgatccaaatttccagcttttcgataccttgatcatcgatgaagtctcacaggccatggaaccacaatgctggatcccactaattgcacatcaaaatcagttccacaaactagtccttgctggtgacaataaacaattgccacccacaatcaaaacagaagacgacaaaaatgtcattcacaatttggaaaccacactatttgacagaataatcaaaatattcccgaaaagggatatggtaaaatttcttaacgttcaatacaggatgaatcaaaaaattatggaatttccatcgcactcaatgtataatgggaaactattggccgatgcaacggtcgcgaacagacttttgatagacctaccgaccgtcgatgctacgccatctgaggatgatgacgatacaaaaattcctttaatttggtatgatacgcaaggtgatgaatttcaagagactgcagatgaagctactatccttggatctaagtataatgagggcgaaattgccattgtaaaagaacacattgagaatttaaggtcattcaacgtcccggagaactctataggtgttatttctccatacaatgcacaagtttctcatctgaaaaaattgatccatgatgaattaaaattaactgatattgaaatatcaactgtagatgggttccagggccgtgaaaaagatgttatcatattgagtttagttcgtagcaatgaaaaatttgaagttggtttccttaaggaagaacgaagactgaacgtcgccatgacaagacccagaaggcaactagttgttgttggcaatatagaagttctgcaaaggtgcggtaacaagtacctaaaaagttggtcagaatggtgtgaagagaacgctgacgtaaggtaccccaacattgacgattatttgtaa

SEQ ID NO: 87 - protein, 683 aa, Saccharomyces cerevisiae
MNKELASKFLSSIKHEREQDIQTTSRLLTTLSIQQLVQNGLAINNIHLENIRSGLIGKLYMELGPNLAVNDKIQRGDIKVGDIVLVRPAKTKVNTKTKPKVKKVSEDSNGEQAECSGVVYKMSDTQITIALEESQDVIATTFYSYSKLYILKTTNVVTYNRMESTMRKLSEISSPIQDKIIQYLVNERPFIPNTNSFQNIKSFLNPNLNDSQKTAINFAINNDLTIIHGPPGTGKTFTLIELIQQLLIKNPEERILICGPSNISVDTILERLTPLVPNNLLLRIGHPARLLDSNKRHSLDILSKKNTIVKDISQEIDKLIQENKKLKNYKQRKENWNEIKLLRKDLKKREFKTIKDLIIQSRIVVTTLHGSSSRELCSLYRDDPNFQLFDTLIIDEVSQAMEPQCWIPLIAHQNQFHKLVLAGDNKQLPPTIKTEDDKNVIHNLETTLFDRIIKIFPKRDMVKFLNVQYRMNQKIMEFPSHSMYNGKLLADATVANRLLIDLPTVDATPSEDDDDTKIPLIWYDTQGDEFQETADEATILGSKYNEGEIAIVKEHIENLRSFNVPENSIGVISPYNAQVSHLKKLIHDELKLTDIEISTVDGFQGREKDVIILSLVRSNEKFEVGFLKEERRLNVAMTRPRRQLVVVGNIEVLQRCGNKYLKSWSEWCEENADVRYPNIDDYL

SEQ ID NO: 88 - DNA, 414 bp, Saccharomyces cerevisiae
  CDS (1)..(414)
atggaaactgaagtacctgcaccagtgcgaactcattcatatgccttagacagatatgttagacagaaaaggagggaaaaacaaagaaagcagagcttaaagcgcgtcgaaaagaaatatactcctagtgaattagctctgtacgaaattcgaaaataccaacgttccacggatttattaatctccaaaattccatttgcaaggctagtgaaagaagttacagacgagtttacaactaaagatcaggatttacgttggcagtcaatggcgattatggcgttacaggaagcaagcgaagcgtatctggtaggattattggaacatacaaacctcttggcgctgcatgcaaaaagaattactataatgaagaaagacatgcaactagcaagaagaatcaggggacagtttatttag

SEQ ID NO: 89 - protein, 137 aa, Saccharomyces cerevisiae
METEVPAPVRTHSYALDRYVRQKRREKQRKQSLKRVEKKYTPSELALYEIRKYQRSTDLLISKIPFARLVKEVTDEFTTKDQDLRWQSMAIMALQEASEAYLVGLLEHTNLLALHAKRITIMKKDMQLARRIRGQFI

SEQ ID NO: 90 - DNA, 1293 bp, Saccharomyces cerevisiae
  CDS (1)..(1293)
atggatgatataagcggaaggcaaactttacctcgaataaaccgtttgttggagcacgtgggaaatccccaagatagtttgtcaatcctacatatagcgggaacaaatggtaaggagacagtatctaaatttttgacatccatattgcagcatccggggcaacagcggcaaagggtcttgattggtaggtatactacatcttccttgctaaacgccaaagaagaggatattagcattaataatgaagccatttccttgatagagtattctaggatcgagaaggaacttatagaagcagatagttctttgaaattacagtgcaacaacctcgaactgctaacaagcgtagctctcgtatacttcgctaagaaaaattgccaatggtgcataatagaaactggtttagctggaaaacaggaccctggaagtataattgctggtcaaagtagagtctgttgcgccattactaacgtgggcattagcgatgaagcttttttatgcaagtttttgtctcaaattactgaaagttccacaaataaagcaatttttctattagacggttctaatgacgaatttgtacgaaatacgataacgaaacggtgccatgatgttggatgtccattagaaatcaccgacccttctcttagggattacaatgtacacacagacacatggggcactcttgaagttcgcctgccatacagtgaagaagaatatcaaatatttaatttgagagttgcgatagcggttttagactttttgagcaaggaaaaaaaggtttgtatttcaaaggatcaactatcccaaggtttaatatctgtggattggccaagaagtttacatcgcttggattactgttatgaatctactagtggaaagaaaatcgcattactattagacaacgcaaataatgcgaaggcagctcgaaatttagcctgccatttaaggaccacgtacggtgatacgccattaacatttgtcattgctataacaactgggaaaaaggtgtctcccttacttgatccgctaatacgtccacaagattatgttattgtgactagatttgggtcagtggttggaatgccgtggatccaatccctagaaccggtgaatcttctcgcatttatcaaaaaccggtatacgagaaatgttaacatgcagccggatcttcaaagtgtctggaccttccttgaaacaagtgggttaaagacgattgttcctgttatcgtatgtggatcactgtatatctgcaaagagctattgcgcttacacaactgtcacttgccagtatag

SEQ ID NO: 91 - protein, 430 aa, Saccharomyces cerevisiae
MDDISGRQTLPRINRLLEHVGNPQDSLSILHIAGTNGKETVSKFLTSILQHPGQQRQRVLIGRYTTSSLLNAKEEDISINNEAISLIEYSRIEKELIEADSSLKLQCNNLELLTSVALVYFAKKNCQWCIIETGLAGKQDPGSIIAGQSRVCCAITNVGISDEAFLCKFLSQITESSTNKAIFLLDGSNDEFVRNTITKRCHDVGCPLEITDPSLRDYNVHTDTWGTLEVRLPYSEEEYQIFNLRVAIAVLDFLSKEKKVCISKDQLSQGLISVDWPRSLHRLDYCYESTSGKKIALLLDNANNAKAARNLACHLRTTYGDTPLTFVIAITTGKKVSPLLDPLIRPQDYVIVTRFGSVVGMPWIQSLEPVNLLAFIKNRYTRNVNMQPDLQSVWTFLETSGLKTIVPVIVCGSLYICKELLRLHNCHLPV

SEQ ID NO: 92 - DNA, 693 bp, Saccharomyces cerevisiae
  CDS (1)..(693)
atgcctgtcccatctgttactgtcactaccgataatgaatatgaagacatatcgtccttttcttctattgactcttacaaaccggagccctttactgggttcaaagattctgaagctccagaacagcctcttttaaaaaacgataccattgttggaaaggggcaactggaagatgatagtaatgtagatgatcaacaccgtcattcagatgtgcattctcatcacagttctagtactttaaaaaggccaacttcaaattcgatagaaaagatggttacccacaatgctttagagggcaactcagaaacagttgattccttaaaagaagatggtttaaatttgaacaagaaagctcttccggatattaccgccccagtaacaaactcagctcacgatgctgcatttccagaagagtatcgtttagaaactgaaaccgggttggtcaaattgaagacgcttgaaagtttgaagagggaggactctcgcgtatcctcaactaaaaaagagcatattaacgaccatacagatatgcattcgacacgatccaaggttactacaaattctcaaggttcttctctagaaccaaacaagttgaacatggcagtagagaagaataagaagaggatcgaaaaatatcaaaaacataaatcagaaaaggggatcaaggggttttttcatagaattttcgattaa

SEQ ID NO: 93 - protein, 230 aa, Saccharomyces cerevisiae
MPVPSVTVTTDNEYEDISSFSSIDSYKPEPFTGFKDSEAPEQPLLKNDTIVGKGQLEDDSNVDDQHRHSDVHSHHSSSTLKRPTSNSIEKMVTHNALEGNSETVDSLKEDGLNLNKKALPDITAPVTNSAHDAAFPEEYRLETETGLVKLKTLESLKREDSRVSSTKKEHINDHTDMHSTRSKVTTNSQGSSLEPNKLNMAVEKNKKRIEKYQKHKSEKGIKGFFHRIFD

SEQ ID NO: 94 - DNA, 510 bp, Saccharomyces cerevisiae
  CDS (1)..(510)
atgtacattcctaaacattttgagtccatggaactctcaaggtacaaattatcaaaaaaacccccgctaggaacactattctcctctaaggctagcaggcaaggtttcttcggatggagaacttcttccaataaagatgaccccgattttggtatgtgcgcatcacatattccatttgtattcgtggagttcgataatggagagcataaacttattgcacatttagcacggaagaataaacatgtggaaatgctggaaagagttcaaaaatgcttagtggtatttcagagcgtcgattcatacatttctccggcgtggttcccaatgaagaaaaagacccataagttcgtaccaacatgggattttgccgctgtgcacgtttacggtacaccaaggattatccgcgacgataaagactggcttattaatatgttatcaactttgactgaccaagaagaagagaaaagacctgagggggaaaatgtacgaagtaaagtggagcgtttctga

SEQ ID NO: 95 - protein, 169 aa, Saccharomyces cerevisiae
MYIPKHFESMELSRYKLSKKPPLGTLFSSKASRQGFFGWRTSSNKDDPDFGMCASHIPFVFVEFDNGEHKLIAHLARKNKHVEMLERVQKCLVVFQSVDSYISPAWFPMKKKTHKFVPTWDFAAVHVYGTPRIIRDDKDWLINMLSTLTDQEEEKRPEGENVRSKVERF

SEQ ID NO: 96 - DNA, 369 bp, Saccharomyces cerevisiae
  CDS (1)..(369)
atggcagtacccgggtattacgaattatatcgtagaagtactatagggaatagtttggtggatgctcttgatactttaattagtgatgggagaatagaagcgtcgttagctatgcgtgttttagagacatttgacaaagtggtggctgagactttaaaagacaatacccaatctaaattgactgtgaaaggaaacctggacacatatggattttgcgatgatgtttggacttttatcgtaaaaaattgtcaggttactgttgaggacagccaccgcgacgcctcccagaacgggtctggagatagccaaagtgtaatttcggtggataagttgaggattgtggcatgtaactcaaaaaagagcgagtaa

SEQ ID NO: 97 - protein, 122 aa, Saccharomyces cerevisiae
MAVPGYYELYRRSTIGNSLVDALDTLISDGRIEASLAMRVLETFDKVVAETLKDNTQSKLTVKGNLDTYGFCDDVWTFIVKNCQVTVEDSHRDASQNGSGDSQSVISVDKLRIVACNSKKSE

SEQ ID NO: 98 - DNA, 336 bp, Saccharomyces cerevisiae
  CDS (1)..(336)
atgactaaaagtatatatattatcatcggatatatgctacatgatgaggagtttttctatttcttttttatttcattctatacactttggatcgtgttttttcttttgcacttgagtttcttttcaacattatcattcggtatatttcacgattttgacaccgatgtttacataaaagtgggtaattatattttgcattttctcgaattgagtaaaaatagtaaccttttaaagaattcttcagaaatgttaaagcatttccgattggcatcattgatgtatatgtacgtatatactcagatgatttgcccctcgttacttggcatcaggaattag

SEQ ID NO: 99 - protein, 111 aa, Saccharomyces cerevisiae
MTKSIYIIIGYMLHDEEFFYFFFISFYTLWIVFFLLHLSFFSTLSFGIFHDFDTDVYIKVGNYILHFLELSKNSNLLKNSSEMLKHFRLASLMYMYVYTQMICPSLLGIRN

SEQ ID NO: 100 - DNA, 801 bp, Saccharomyces cerevisiae
  CDS (1)..(801)
atgttcttaagaagcgttaaccgtgccgtcactagaagcattttgactacgcccaagccagccgtagtaaaatcatcgtggagagtttttactgttgctaactctaagagatgtttcacacccgctgcaatcatgaggaaccaagagacccaaagagtaggtgatattttgcaatctgaattgaaaattgagaaggaaacgttaccagagtcaacgtcgttagactcatttaatgactttttgaacaaatataagttctcattagtagagacacccggtaagaatgaagctgaaatagttagaagaaccgaatcaggcgaaacagttcatgttttttttgacgtagctcagattgctaatctgccttacaacaacgcaatggatgaaaataccgagcaaaatgaagacggcattaatgaggatgattttgatgctttatcagacaactttgccaacgttaatgttgttatttctaaagaaagcgcaagcgaacctgcagtctcatttgaattactaatgaatttacaggaaggttcattttatgttgatagtgctactccatacccctcagttgatgctgctttgaatcagtctgctgaggccgaaataacaagagaattggtataccatggcccacctttttcaaacttggacgaagaactacaagaatctctggaagcttatttggaaagtagaggtgtcaatgaagagctagcctctttcattagtgcatattccgagttcaaagagaataacgagtatatttcttggttggaaaagatgaagaagtttttccactaa

SEQ ID NO: 101 - protein, 266 aa, Saccharomyces cerevisiae
MFLRSVNRAVTRSILTTPKPAVVKSSWRVFTVANSKRCFTPAAIMRNQETQRVGDILQSELKIEKETLPESTSLDSFNDFLNKYKFSLVETPGKNEAEIVRRTESGETVHVFFDVAQIANLPYNNAMDENTEQNEDGINEDDFDALSDNFANVNVVISKESASEPAVSFELLMNLQEGSFYVDSATPYPSVDAALNQSAEAEITRELVYHGPPFSNLDEELQESLEAYLESRGVNEELASFISAYSEFKENNEYISWLEKMKKFFH

SEQ ID NO: 102 - DNA, 966 bp, Saccharomyces cerevisiae
  CDS (1)..(966)
atgactcgtcccccattggttcgtggaatcttttcgttaggtctttctgtagccgttttgaaaggtgttgaaaaaacagttcgtaagcatttggaaagacagggatggatagagccccagaaagtggactatgagttaattttcactatagataggttgaaaaacttggtagataataagcgtgaggctttaactgcggaacaacccgacgctggtgaactgagctggcgtaaagtatttaatttcatttccagacaatccagcgaattggacacacgaatatacgttcttatactactcctatcctttctactacctatcgcgtggactgtactggacggtgatcgcgagaccacgctagaagataaggataacgattgtaatgtagatcttattgaaaacgaaaggaggctgaagcattacaacgatggtgaaagagcagtattgcaatttggtaaaaatagatccgaacctattatattaagctataaggacatgaacgttttggaaggggaacatgagtttacctccaaagaggaacacagtaacagccatttgacaagcaagagcgaaaatgcactaaaccaagtagggagtgaagatttgttaggttgtcacctggaaaagcaattggaagaagacaaaaatgaaccgaatggagaagcagacggtgaggatgataataaccgggaaaaggattgcagctccagttcagaagttgagtcgcagagtaaatgccgaaaggaaagtactgcagagcctgactctctctcacgggataccagaacaacctcttcccttaaatcaagtacatcattccccatatcattcaagggctcgatagaccttaagtcgttaaaccagccttcatcattgttgcatatacaagtatctcccacaaaatctagtaatctagatgcacaagtgaacactgaacaagcatactctcaaccatttagatactaa

SEQ ID NO: 103 - protein, 321 aa, Saccharomyces cerevisiae
MTRPPLVRGIFSLGLSVAVLKGVEKTVRKHLERQGWIEPQKVDYELIFTIDRLKNLVDNKREALTAEQPDAGELSWRKVFNFISRQSSELDTRIYVLILLLSFLLPIAWTVLDGDRETTLEDKDNDCNVDLIENERRLKHYNDGERAVLQFGKNRSEPIILSYKDMNVLEGEHEFTSKEEHSNSHLTSKSENALNQVGSEDLLGCHLEKQLEEDKNEPNGEADGEDDNNREKDCSSSSEVESQSKCRKESTAEPDSLSRDTRTTSSLKSSTSFPISFKGSIDLKSLNQPSSLLHIQVSPTKSSNLDAQVNTEQAYSQPFRY

SEQ ID NO: 104 - DNA, 504 bp, Saccharomyces cerevisiae
  CDS (1)..(504)
atgaatctaagatttgaattgcagaaactattgaacgtttgctttttgtttgcatctgcttacatgttctggcaaggcttagccattgctactaatagcgcttctccgatcgtggtggtgctttcaggctccatggaaccagctttccaaaggggtgatatccttttcctatggaatagaaatactttcaaccaagtaggtgatgtcgtggtgtatgaggtcgaagggaaacaaatccccattgtgcatagagttttgaggcaacataacaatcacgcggacaagcaattcctcctgaccaaaggtgacaataacgccggcaatgatatctcactatatgctaataagaaaatttacttgaacaagtcaaaggagattgtagggaccgtcaagggctactttccacaactagggtacattacgatttggattagcgagaacaaatatgccaagtttgcattgttaggtatgttggggttgagtgctctgctggggggcgagtag

SEQ ID NO: 105 - protein, 167 aa, Saccharomyces cerevisiae
MNLRFELQKLLNVCFLFASAYMFWQGLAIATNSASPIVVVLSGSMEPAFQRGDILFLWNRNTFNQVGDVVVYEVEGKQIPIVHRVLRQHNNHADKQFLLTKGDNNAGNDISLYANKKIYLNKSKEIVGTVKGYFPQLGYITIWISENKYAKFALLGMLGLSALLGGE

SEQ ID NO: 106 - DNA, 2490 bp, Saccharomyces cerevisiae
  CDS (1)..(2490)
atggccaagaggaaatatggcaggtcttattccctcgatgatacagattcctgcagcaataaagtcctgatagtaccaaccggtcaaagctcctctaacgcaatcactgatttctctgtcagaaaggcgcatgcttgcgatagatgcagactgaaaaaaatcaagtgtgacggtttaaaaccgaactgttcaaactgtgcgaaaattgacttcccttgcaaaacctcggataaactgtcgaggagaggtcttccaaaggggtatacagaactactagaaaaagaggtcgtccgtttgacaaatatgaatgcgagttccagcgccaatgcaaattctaatttgccgttcattaatgatacattttattgttttgataattacaacactcagtctgaaaatcaaaggtttttgggacatttgacatggaatattctaactaatacttttcctactcaaaaagcagtagtttttacagacgatcgaaataatattgatctacaactgcaactgttaacaaattttttgaacctgaatggtgactttaatcatctcccaaattttcttttacttaaatatgattataaccttcagtttttgaaaaatttgttgtctgtcattattaaagatttttttaaaaggcaaaattctttgctacttctattataccctacaaatttatggaaaaatttgctattagacaagattaattcaaccgcaatgacaggtgaacccataactctactggcgttactttatattattcaatttacttggtcttgttttgatgatttcaagctttttaaagtcacgaagcttattgtttctctgacaacaaacagcaaattagacttgaaagttttgcaattggttaacttatccatcttttattttatgggcgcctctgttgactcttgtaaaagtaaaagctcgttaacagaacattcaaatgtaaattcagtaatatggaccaatgatttgctaaacctaaactttacaaatattttgaatatgggattgtacataaatcccaaaaatttaattcctatatcaggcaacaataataataataaatctaatgaagaggatgatagaatagtgacattttggtgctttcaattcttaagctcatggtggtccttaattcaaggtttaccaaagtccaactttttaactgaagaatttcaaccgaaatcaatctcggttctagaaatccccaggctgaagccctttgaaattttgttaaacttcatcatatattctttggatggatgtaatttgttgaatatctcatctttaaatgtttcggacccaaatttccaatttttccagaatgaactggaaagctttaaaaaaaatttattactgtggaacctttatcacaatttgagtgatcacgataacttccgattcttaacatccagttcaaataaaaaactaacaacaaatttactacttaagaatttgacgggtctaaatcacaaactcaatcaacctgattttgtggagattcaattaactttattttacttgagtttaaaattaatgactttaaaggaaggggaccaagatttgaagaaagaggatatctcgttagagatattgtccctatattttttaattcttacagatgactctaataatgatgataatcaacagttacaaccacagcaactaaatctctaccattttacgcccttcaatagtattgacattattgacttatgtttaaacaatttaaacaattggtcattatcacttaaatacgaaagtggtcaaaaccagccccactcaagtaaaataaagtttgaaaaatttcaaaactttttaaatcactggtgtccaatatggtactatgatgaattttccacaaacccttttttacaaatcctcaaaatcaatttcaaattacttccttttgagacaatccattactcacaagaagagcaacgattgttaataagtttgaataaattgagatatttggatgccgtatcgagctttaattcaagttcagtcaagtcgaatttcgcgtctaaggtcaatacccagctaaaccttttgcaacactcgagttctaactccaatttcctagatgcgtcaccatacgattttaataaaatttttatgaacaactttgaaaactatgactacgaaacagatgaaggatatgcggaagatgatgatgaagaggatagtgacagtgacaatagcttaccactagaaattccttttaaaaaaagtaaaaataaatgcaagaataggaataaagagctttcacaaaggttatccctatttgaaaacagagatagcaattcggtagatttcaacacagatacaaatttaaatttaaaccctgattcgccatcagttacgtcttctaagaaaaaatatttagatcatattattttagataaccgagacatcgttagcaaccatgactccagtaaacaaaaattcaagatccagaatattttgaactcgaccttctaa

SEQ ID NO: 107 - protein, 829 aa, Saccharomyces cerevisiae
MAKRKYGRSYSLDDTDSCSNKVLIVPTGQSSSNAITDFSVRKAHACDRCRLKKIKCDGLKPNCSNCAKIDFPCKTSDKLSRRGLPKGYTELLEKEVVRLTNMNASSSANANSNLPFINDTFYCFDNYNTQSENQRFLGHLTWNILTNTFPTQKAVVFTDDRNNIDLQLQLLTNFLNLNGDFNHLPNFLLLKYDYNLQFLKNLLSVIIKDFFKRQNSLLLLLYPTNLWKNLLLDKINSTAMTGEPITLLALLYIIQFTWSCFDDFKLFKVTKLIVSLTTNSKLDLKVLQLVNLSIFYFMGASVDSCKSKSSLTEHSNVNSVIWTNDLLNLNFTNILNMGLYINPKNLIPISGNNNNNKSNEEDDRIVTFWCFQFLSSWWSLIQGLPKSNFLTEEFQPKSISVLEIPRLKPFEILLNFIIYSLDGCNLLNISSLNVSDPNFQFFQNELESFKKNLLLWNLYHNLSDHDNFRFLTSSSNKKLTTNLLLKNLTGLNHKLNQPDFVEIQLTLFYLSLKLMTLKEGDQDLKKEDISLEILSLYFLILTDDSNNDDNQQLQPQQLNLYHFTPFNSIDIIDLCLNNLNNWSLSLKYESGQNQPHSSKIKFEKFQNFLNHWCPIWYYDEFSTNPFLQILKINFKLLPFETIHYSQEEQRLLISLNKLRYLDAVSSFNSSSVKSNFASKVNTQLNLLQHSSSNSNFLDASPYDFNKIFMNNFENYDYETDEGYAEDDDEEDSDSDNSLPLEIPFKKSKNKCKNRNKELSQRLSLFENRDSNSVDFNTDTNLNLNPDSPSVTSSKKKYLDHIILDNRDIVSNHDSSKQKFKIQNILNSTF

SEQ ID NO: 108 - DNA, 1731 bp, Saccharomyces cerevisiae
  CDS (1)..(1731)
atgatcgccttaccagtagagaaggcccctagaaagtccctatggcaaaggcacagagcctttattagtggaatagttgcccttattatcatcggcaccttcttcctcacttcgggtctccacccagcaccacctcatgaggcaaagcgtccacaccatggaaaaggtcccatgcactcacccaaatgtgagaagattgaaccattaagtccatcattcaaacattccgtcgacacaattcttcatgaccctgcctttagaaacagctccattgagaaactgtccaatgctgttagaatccccactgtagtccaagacaaaaaccccaaccccgcagatgatccggatttctataagcatttttatgaactacacgactattttgagaagactttccctaatattcacaagcatttgaaattggagaaagtcaatgagctgggtcttctatacacatgggaaggttctgatcctgatctaaaaccattattgttaatggcccatcaagatgttgtacctgtaaacaacgaaactttatcatcctggaagttccctccattttctggtcactatgatccagaaacagattttgtttgggggcgtggttctaacgattgtaagaacttgttaattgccgagtttgaagctatcgaacaactgttgatagatggattcaagcccaacagaactattgttatgtcgcttggttttgatgaagaagcaagcggcaccctcggtgctgccagcttagcctcatttcttcacgaaagatatggtgatgatggtatttacagtatcattgacgagggtgaaggtatcatggaagtcgacaaggatgtctttgttgccactccaatcaacgctgaaaaaggctatgtcgacttcgaagtcagtattctaggccatggtggtcattcctctgtcccacctgatcataccacaatcggtatcgcttcagaactgattactgaatttgaagccaacccatttgactacgaatttgagtttgacaatccaatctatggattgttgacatgtgctgctgaacattctaaatctttaagtaaggatgtgaagaagacaattttgggcgcaccattctgtcctagaaggaaggacaagcttgttgagtacatttccaaccaatcacatttgcgcagcttaataagaacaacacaagctgttgatatcatcaatggtggtgttaaagctaatgctctgcccgaaactaccagattcttgatcaatcacagaattaatttacattcttctgtggctgaagtctttgaaagaaacatagaatatgcgaaaaagattgctgagaagtatggctatggtttatctaagaacggtgacgattacattatccctgaaaccgagttaggtcacattgacattactctcttgagagaattggaaccagcaccactttcgccaagttcaggccctgtttgggacattttggcaggtactattcaagatgtttttgaaaacggtgttctacaaaacaacgaagagttctatgtgactactggtttattctctggtaacaccgatactaaatactactggaatttgtccaagaacatttataggtttgttggctctatcattgatattgatttactgaagacattgcattcggttaatgaacacgtggatgtcccaggtcatttatctgccattgcctttgtttacgagtatatcgttaatgttaacgaatacgcttaa

SEQ ID NO: 109 - protein, 576 aa, Saccharomyces cerevisiae
MIALPVEKAPRKSLWQRHRAFISGIVALIIIGTFFLTSGLHPAPPHEAKRPHHGKGPMHSPKCEKIEPLSPSFKHSVDTILHDPAFRNSSIEKLSNAVRIPTVVQDKNPNPADDPDFYKHFYELHDYFEKTFPNIHKHLKLEKVNELGLLYTWEGSDPDLKPLLLMAHQDVVPVNNETLSSWKFPPFSGHYDPETDFVWGRGSNDCKNLLIAEFEAIEQLLIDGFKPNRTIVMSLGFDEEASGTLGAASLASFLHERYGDDGIYSIIDEGEGIMEVDKDVFVATPINAEKGYVDFEVSILGHGGHSSVPPDHTTIGIASELITEFEANPFDYEFEFDNPIYGLLTCAAEHSKSLSKDVKKTILGAPFCPRRKDKLVEYISNQSHLRSLIRTTQAVDIINGGVKANALPETTRFLINHRINLHSSVAEVFERNIEYAKKIAEKYGYGLSKNGDDYIIPETELGHIDITLLRELEPAPLSPSSGPVWDILAGTIQDVFENGVLQNNEEFYVTTGLFSGNTDTKYYWNLSKNIYRFVGSIIDIDLLKTLHSVNEHVDVPGHLSAIAFVYEYIVNVNEYA

SEQ ID NO: 110 - DNA, 1473 bp, Saccharomyces cerevisiae
  CDS (1)..(1473)
atgttcaggatacaactgagaactatgtccagcaaaacatgcaagagtgattacccaaaggagtttgtcagtttcttaaatagctcacactctccttaccatacagttcataacatcaaaaagcatctggtgtcaaatggcttcaaagagttgagcgaacgtgactcgtgggctggccacgtcgcacaaaaaggaaagtactttgtgacaagaaatggctcttccattattgcgtttgctgttggtggaaagtgggagcctggtaatccaattgccattacgggtgctcacaccgactcccccgcattaaggattaagcctatttctaaaagagtcagtgagaagtatttacaagtgggcgtggaaacttatggtggcgctatttggcattcatggtttgataaggatttgggcgttgccggaagagttttcgtaaaggatgcgaaaactggcaaatccattgctagattggtggatttgaatagacctctgttaaagattcctactttggctattcatctggacagagacgtaaatcaaaaattcgagtttaatagagaaactcaactgttgccgattggtggtctgcaagaagacaaaactgaagcgaaaactgaaaaggaaattaataacggtgagtttacctccataaaaacgatagtacagaggcatcacgcagaacttttggggctaatagccaaagaactcgccattgatacaattgaagacattgaagacttcgaattgatcctttatgatcataatgcatccactctaggtgggttcaacgatgagtttgtcttctctggtcgattggataatttgacatcttgtttcacatcaatgcacggtttaacgttggcggctgacacagaaattgaccgagaatcaggcattagattgatggcatgctttgatcatgaggagattggctcatcctccgcccaaggggcagattctaacttcttgcctaatatattggaaaggttgtccatcctgaagggggacggttctgatcaaactaaacctttgtttcactcggcaatattggaaacttccgctaagtcgtttttcctttcatctgatgttgctcatgcagttcatccaaactatgcaaacaaatacgaaagccaacacaaacccttattgggtggtggtcccgtaatcaagattaacgcgaatcaacgttacatgaccaattcaccagggttggtcttggtgaaaagactagcagaggctgctaaagtccctttgcaattgtttgtcgtagctaacgactcaccatgcggttctaccatcggccccattttggcctcaaagacaggtattagaactctagacttgggtaatcctgtgttgagtatgcattcgattagagagaccggtggctctgcagacctggagttccaaatcaagttatttaaggaattttttgaacgctacacttccatagaatctgaaattgttgtctaa

SEQ ID NO: 111 - protein, 490 aa, Saccharomyces cerevisiae
MFRIQLRTMSSKTCKSDYPKEFVSFLNSSHSPYHTVHNIKKHLVSNGFKELSERDSWAGHVAQKGKYFVTRNGSSIIAFAVGGKWEPGNPIAITGAHTDSPALRIKPISKRVSEKYLQVGVETYGGAIWHSWFDKDLGVAGRVFVKDAKTGKSIARLVDLNRPLLKIPTLAIHLDRDVNQKFEFNRETQLLPIGGLQEDKTEAKTEKEINNGEFTSIKTIVQRHHAELLGLIAKELAIDTIEDIEDFELILYDHNASTLGGFNDEFVFSGRLDNLTSCFTSMHGLTLAADTEIDRESGIRLMACFDHEEIGSSSAQGADSNFLPNILERLSILKGDGSDQTKPLFHSAILETSAKSFFLSSDVAHAVHPNYANKYESQHKPLLGGGPVIKINANQRYMTNSPGLVLVKRLAEAAKVPLQLFVVANDSPCGSTIGPILASKTGIRTLDLGNPVLSMHSIRETGGSADLEFQIKLFKEFFERYTSIESEIVV

SEQ ID NO: 112 - DNA, 570 bp, Saccharomyces cerevisiae
  CDS (1)..(570)
atggatgataagaaaacatggagtacagtcactttgagaaccttcaatcagctggtaacgtcttcgttaattggatactcaaaaaagatggatagcatgaatcacaagatggaaggaaatgcgggccacgaccacagtgatatgcatatgggagatggagatgatacctgttcgatgaatatgctattttcgtggtcatacaagaatacgtgtgtcgtctttgaatggtggcatatcaagaccctgcctggactgattttaagttgtttagcaatttttggtctagcctacctctatgagtacttaaagtactgtgtccataagagacaattatcccagagagtattgttaccaaatagatctctgaccaagatcaaccaagccgacaaagtgtccaatagtattctatatggtttgcaagtgggattctcattcatgctcatgcttgtattcatgacttataatggttggttaatgttagctgtcgtgtgtggggcaatatggggtaattacagctggtgtacttcgtatagtcctgagatagatgacagctccctcgcctgccattaa

SEQ ID NO: 113 - protein, 189 aa, Saccharomyces cerevisiae
MDDKKTWSTVTLRTFNQLVTSSLIGYSKKMDSMNHKMEGNAGHDHSDMHMGDGDDTCSMNMLFSWSYKNTCVVFEWWHIKTLPGLILSCLAIFGLAYLYEYLKYCVHKRQLSQRVLLPNRSLTKINQADKVSNSILYGLQVGFSFMLMLVFMTYNGWLMLAVVCGAIWGNYSWCTSYSPEIDDSSLACH

SEQ ID NO: 114 - DNA, 585 bp, Saccharomyces cerevisiae
  CDS (1)..(585)
atgattcatgcagttctaatattcaataagaaatgccaaccaagattagtgaaattctacacgccggtcgaccttccaaagcaaaaactgctattagagcaagtatatgaattgatttctcaaaggaatagcgattttcaaagttcttttttagtcacgccaccatcgcttctgttaagcaatgaaaataataatgatgaggtaaacaatgaagatattcaaatcatctataaaaactacgctacactatatttcactttcatcgtggatgatcaagaatcagaactggccatattagatctgatccaaacttttgtggaatcattggaccgttgttttactgaagtcaatgaacttgatttgatttttaactggcaaactttggaaagtgtattagaagaaatcgtgcaggggggcatggtcattgaaacaaatgtgaacagaatagttgcttctgttgacgaactcaacaaagctgccgagtccacagatagtaaaattggaagactaacgtccactggatttggaagcgcactacaagcgtttgctcaaggcggatttgcacaatgggcaacggggcaataa

SEQ ID NO: 115 - protein, 194 aa, Saccharomyces cerevisiae
MIHAVLIFNKKCQPRLVKFYTPVDLPKQKLLLEQVYELISQRNSDFQSSFLVTPPSLLLSNENNNDEVNNEDIQIIYKNYATLYFTFIVDDQESELAILDLIQTFVESLDRCFTEVNELDLIFNWQTLESVLEEIVQGGMVIETNVNRIVASVDELNKAAESTDSKIGRLTSTGFGSALQAFAQGGFAQWATGQ

SEQ ID NO: 116 - DNA, 1038 bp, Saccharomyces cerevisiae
  CDS (1)..(1038)
atggaagcacataaccaatttttgaagactttccaaaaagaacgtcatgatatgaaagaagctgaaaaggatgaaatccttttgatggaaaacagccgtagattcgtgatgttccctatcaaataccacgaaatctgggctgcttacaagaaggttgaagcctctttctggactgcggaagaaatcgaattggctaaggacactgaagatttccaaaaattgactgatgaccagaagacctacatcggtaacttgttagccttgtccatttcttctgacaaccttgtcaacaagtacttgatcgaaaacttttctgcccaattgcaaaaccctgaaggtaagagtttctacgggttccagattatgatggaaaacatctactctgaagtttactccatgatggttgatgccttcttcaaggaccctaagaacatccctctattcaaggaaattgccaatttgcctgaagtcaagcataaggctgctttcatcgagagatggatttccaacgatgacagcttgtatgctgaaagactagtagcatttgctgcaaaggaaggtattttccaagctggtaactatgcttctatgttctggttgactgacaaaaagattatgccaggtttagcaatggccaacagaaacatctgtagagacagaggtgcctacactgacttttcatgcttgctatttgcccatttgagaaccaagccaaaccccaagatcattgaaaaaatcattaccgaagccgtggaaattgaaaaggaatactactcaaactctttgccagtagaaaaatttggtatggatttgaagagcattcacacctacatagaatttgtcgctgacggtctattacaaggtttcggtaacgaaaaatactacaacgccgtcaacccattcgaattcatggaggatgtcgctaccgctggtaagaccaccttctttgaaaagaaggtttccgactaccaaaaggccagtgacatgtctaagtccgctaccccatccaaggaaattaactttgatgatgacttctaa

SEQ ID NO: 117 - protein, 345 aa, Saccharomyces cerevisiae
MEAHNQFLKTFQKERHDMKEAEKDEILLMENSRRFVMFPIKYHEIWAAYKKVEASFWTAEEIELAKDTEDFQKLTDDQKTYIGNLLALSISSDNLVNKYLIENFSAQLQNPEGKSFYGFQIMMENIYSEVYSMMVDAFFKDPKNIPLFKEIANLPEVKHKAAFIERWISNDDSLYAERLVAFAAKEGIFQAGNYASMFWLTDKKIMPGLAMANRNICRDRGAYTDFSCLLFAHLRTKPNPKIIEKIITEAVEIEKEYYSNSLPVEKFGMDLKSIHTYIEFVADGLLQGFGNEKYYNAVNPFEFMEDVATAGKTTFFEKKVSDYQKASDMSKSATPSKEINFDDDF

SEQ ID NO: 118 - DNA, 330 bp, Saccharomyces cerevisiae
  CDS (1)..(330)
atgtcacagatagcacaagaaatgacagtgagcttaagaaacgccaggacacaattggatatggtcaatcagcagctagcatatttggacagacaagaaaagcttgctgaattgacaaagaaagaactagagtcttatccaacggacaaagtatggagatcttgcggtaaatcgtttatcttacaggataaatccaaatacgttaatgatttatcacatgccgaaactgttcttctggatcaaagaaaaacattaaagataaagaagaactatttagaaactactgttgaaaaaacaatagacaatctaaaggcattgatgaagaattaa

SEQ ID NO: 119 - protein, 109 aa, Saccharomyces cerevisiae
MSQIAQEMTVSLRNARTQLDMVNQQLAYLDRQEKLAELTKKELESYPTDKVWRSCGKSFILQDKSKYVNDLSHAETVLLDQRKTLKIKKNYLETTVEKTIDNLKALMKN

SEQ ID NO: 120 - DNA, 648 bp, Saccharomyces cerevisiae
  CDS (1)..(648)
atgaatggaattcaagtggacatcaatcgtttgaaaaagggcgaagtcagtttaggtacctcaattatggccgtgacatttaaggatggtgtgatactaggtgctgattcacgtaccaccactggtgcgtacatagctaaccgtgtgacagataaattaacgagagtacatgacaaaatttggtgttgtaggtccggttctgcagcagacacgcaggcgattgccgacattgttcagtaccatttggaattatatacttctcaatatggtaccccctccacagagactgctgcctcggtgttcaaagaattatgttacgaaaataaagataaccttactgctggtataattgtggctggttatgatgacaaaaacaaaggggaagtatatactattccattgggtggctccgtccataagctgccttatgcgatagcaggatctggctctactttcatatatgggtattgtgataaaaactttagagaaaatatgtcaaaggaagaaaccgtagatttcataaagcattcgctatcgcaagccattaaatgggacggatcttccggtggtgttataagaatggttgttttgacagctgctggtgtggaacgtttgatattctaccctgatgaatatgaacaactataa

SEQ ID NO: 121 - protein, 215 aa, Saccharomyces cerevisiae
MNGIQVDINRLKKGEVSLGTSIMAVTFKDGVILGADSRTTTGAYIANRVTDKLTRVHDKIWCCRSGSAADTQAIADIVQYHLELYTSQYGTPSTETAASVFKELCYENKDNLTAGIIVAGYDDKNKGEVYTIPLGGSVHKLPYAIAGSGSTFIYGYCDKNFRENMSKEETVDFIKHSLSQAIKWDGSSGGVIRMVVLTAAGVERLIFYPDEYEQL

SEQ ID NO: 122 - DNA, 990 bp, Saccharomyces cerevisiae
  CDS (1)..(990)
atgtgcagtaggatactcttgtccggtttagtcggactgggtgctggtactggcttaacctatcttcttttgaacaaacattctccaacgcaaatcattgagacaccttatccacctacccagaaacctaatagtaatattcaatctcactctttcaacgtcgatccttccgggttcttcaagtatggttttcctggtccgattcatgatctgcagaaccgcgaagagtttatctcatgttacaacagacaaactcaaaatccttattgggtcctcgaacatataacgccagaatcattggctgcaaggaatgctgacagaaaaaattcctttttcaaggaagatgaagtaattccagaaaagtttagaggtaaactaagagactattttaggtcgggctatgatcgaggccatcaagccccagctgcagacgcaaaattttctcaacaggccatggatgatacattctacttatccaatatgtgtcctcaagtaggagaaggttttaatagagactattgggcgcatttggagtacttttgtaggggattgactaagaaatataagagtgtaagaatcgtgactggtccattgtatctacccaaaaaggatcccatagataataaatttagggttaattatgaagttattggcaatccacccagtattgctgttccaacgcacttttttaaattgattgttgcagaagcaccaacagccaatcctgctagagaggatattgctgtcgcggcatttgtattgccaaacgaaccgatatcaaatgagacgaaattgactgactttgaagttcctatagatgctttagagagaagtactgggctagaacttctgcaaaaagtaccaccttcaaagaagaaggcattatgcaaagaggtaaattgtcaaattgtagtgagagatttctctaacgcggcgatcaaacaatcgaaagatgtgaaattgttacctcctccaaaaaaaaggaattga

SEQ ID NO: 123 - protein, 329 aa, Saccharomyces cerevisiae
MCSRILLSGLVGLGAGTGLTYLLLNKHSPTQIIETPYPPTQKPNSNIQSHSFNVDPSGFFKYGFPGPIHDLQNREEFISCYNRQTQNPYWVLEHITPESLAARNADRKNSFFKEDEVIPEKFRGKLRDYFRSGYDRGHQAPAADAKFSQQAMDDTFYLSNMCPQVGEGFNRDYWAHLEYFCRGLTKKYKSVRIVTGPLYLPKKDPIDNKFRVNYEVIGNPPSIAVPTHFFKLIVAEAPTANPAREDIAVAAFVLPNEPISNETKLTDFEVPIDALERSTGLELLQKVPPSKKKALCKEVNCQIVVRDFSNAAIKQSKDVKLLPPPKKRN

SEQ ID NO: 124 - DNA, 360 bp, Saccharomyces cerevisiae
  CDS (1)..(360)
atgccgcatttagccgccgaagcgcatacttggcctccgcatatttcacattcaacactttcgattccgcatccaaccccggaacaccggcacgtatttcataaaaaggacgtgaagaacaaaaggaacgaagaaaaaggcaataatttactctatgtgttatttagaactacggtgataaagagctcgttccgatcactaagtacggccggaagagagctgttgtttgttgtccatcaagggcacatcggcaccggcctcatcgtcttcatcatatgctggaggctgtgcttgagattcctctgcagggtgagcttccaggtcacggtctacggcgggcgcagtcgcatgtctgcgtga

SEQ ID NO: 125 - protein, 119 aa, Saccharomyces cerevisiae
MPHLAAEAHTWPPHISHSTLSIPHPTPEHRHVFHKKDVKNKRNEEKGNNLLYVLFRTTVIKSSFRSLSTAGRELLFVVHQGHIGTGLIVFIICWRLCLRFLCRVSFQVTVYGGRSRMSA

SEQ ID NO: 126 - DNA, 1071 bp, Saccharomyces cerevisiae
  CDS (1)..(1071)
atgttaaaagttcctttgagtgatgttctttcacagaagatgctgtttttaaaaagttttagatattttcattgcacaaaatacttcagcagagacaatgcatcatctaccacagatatatttcgcaacgcaatgaaacgtaaacgtgagctggcaaatcttaaagagcaaagtcatggaaatgtggcaagaaatgctgcttttcctaaagagtatattaagcgcccgaaacaagtgccaaggaatgctactaacaggaaaaaaatcctgattacttggagcaccgggacagatcgagctaaagaggcagctaattcagttgttagtgagatattcaaaaaaaatcacaagggaaacatcaaagttgtggatcccactacccaccgaattgaagcatccaatattcggtattttgccaagggcattgatctcgataaagttggactcagtattgttaatgtagagcaaatcgataatgaaaatcaaattccacttgttaagatagtcgaaagtcgtgtagccttaaaaaaatattcagactttctggctaaaaaaaaggaaaaggaactgatggaattgggagtactgaataagtcttacaagaatttggtgactgataaaaaagaagataacttgaagcatattaaaatatcatggcagattgaaagcgatgatttaaaaaggcagaaggctcacgaaatagtttcgctattgaaaaaagggaataaagtaacgttatatcttgatgacaagaataacataaattcaaacaattggcttgaaaattttgaggagctggaccgctctcaaaaaggtgaaccacccaggctaccagaatcagttttccagaaaagagctgctgtcttggagacattgaaagagatagttagcgaatatgctaatgatcctgttctgctaggtaacatgaactcgaaaatgataatgaaacttataccaaaggacgttaaaccacaaaacaacgataagagggcgttaaaggaattgagaaagaaggagaggcaagaaaaattgcaaaaaaggattcagagaaaaaaaatgaatgaaatgtaa

SEQ ID NO: 127 - protein, 356 aa, Saccharomyces cerevisiae
MLKVPLSDVLSQKMLFLKSFRYFHCTKYFSRDNASSTTDIFRNAMKRKRELANLKEQSHGNVARNAAFPKEYIKRPKQVPRNATNRKKILITWSTGTDRAKEAANSVVSEIFKKNHKGNIKVVDPTTHRIEASNIRYFAKGIDLDKVGLSIVNVEQIDNENQIPLVKIVESRVALKKYSDFLAKKKEKELMELGVLNKSYKNLVTDKKEDNLKHIKISWQIESDDLKRQKAHEIVSLLKKGNKVTLYLDDKNNINSNNWLENFEELDRSQKGEPPRLPESVFQKRAAVLETLKEIVSEYANDPVLLGNMNSKMIMKLIPKDVKPQNNDKRALKELRKKERQEKLQKRIQRKKMNEM

SEQ ID NO: 128 - DNA, 402 bp, Saccharomyces cerevisiae
  CDS (1)..(402)
atggacagagaccatattaatgaccatgaccatcgaatgagctattccatcaacaaggacgacttgttgttaatggttttggcggttttcattcccccagtggccgtctggaagcgtaagggtatgttcaacagggatacactattgaacttacttctcttcctactgttattcttcccagcaatcattcacgcttgctacgttgtatatgaaacgagtagtgaacgttcgtacgatctttcacgcagacatgcgactgcgcccgccgtagaccgtgacctggaagctcaccctgcagaggaatctcaagcacagcctccagcatatgatgaagacgatgaggccggtgccgatgtgcccttgatggacaacaaacaacagctctcttccggccgtacttag

SEQ ID NO: 129 - protein, 133 aa, Saccharomyces cerevisiae
MDRDHINDHDHRMSYSINKDDLLLMVLAVFIPPVAVWKRKGMFNRDTLLNLLLFLLLFFPAIIHACYVVYETSSERSYDLSRRHATAPAVDRDLEAHPAEESQAQPPAYDEDDEAGADVPLMDNKQQLSSGRT

SEQ ID NO: 130 - DNA, 768 bp, Saccharomyces cerevisiae
  CDS (1)..(768)
atggctgtcggaaagaataagagactatccaagggtaagaaaggtcaaaagaagagagtcgttgacccatttaccagaaaggaatggttcgacattaaagctccatccacttttgaaaacagaaatgttggtaagactttagttaacaagtccactggtttgaagagtgcttcagatgctttgaaaggtagagttgtcgaagtttgcttggctgacttacagggttctgaagaccactctttcagaaaaatcaaattaagagttgacgaagtccaaggtaagaatttattgaccaacttccacggtatggacttcactactgataaattgagatccatggttagaaagtggcaaactttgatcgaagctaacgttactgttaagacttctgatgattacgttttgagaatctttgctatcgccttcaccagaaagcaagctaaccaagttaagagacactcttacgctcaatcttcccatatcagagctatcagaaaggttatttccgaaatcttgactaaggaagttcaaggatctaccttggcccaattgacctccaagttgattccagaagttatcaacaaggaaattgaaaacgccaccaaggacattttcccactacaaaacatccatgttagaaaggttaagttgttgaaacaaccaaagttcgatgtcggtgctttgatggctttgcacggtgaaggttctggtgaagaaaagggtaagaaggttaccggtttcaaggacgaagtcttggaaactgtgtaa

SEQ ID NO: 131 - protein, 255 aa, Saccharomyces cerevisiae
MAVGKNKRLSKGKKGQKKRVVDPFTRKEWFDIKAPSTFENRNVGKTLVNKSTGLKSASDALKGRVVEVCLADLQGSEDHSFRKIKLRVDEVQGKNLLTNFHGMDFTTDKLRSMVRKWQTLIEANVTVKTSDDYVLRIFAIAFTRKQANQVKRHSYAQSSHIRAIRKVISEILTKEVQGSTLAQLTSKLIPEVINKEIENATKDIFPLQNIHVRKVKLLKQPKFDVGALMALHGEGSGEEKGKKVTGFKDEVLETV

SEQ ID NO: 132 - DNA, 339 bp, Saccharomyces cerevisiae
  CDS (1)..(339)
atgtatctcagtgcccagcttatgagaactgtcacagcctcccacttgaccctcagagccctctccactccccccctctttcaacatcgccagatagccgccgttgaatggtgcgggacaacccggcctggcctggccaggcaaaaaaggacgcagcacgcctcgagcgttatttccaaatcgggcgtactatcagccaagcccagctcggtatttttagcgcttctcgcaggaaaattggctgagaagtatatatacgcgagaatgttgctcttccatgtctcagtagtcaatgagtgtccagtggtgtttcattctggaccagttgtttggaagtag

SEQ ID NO: 133 - protein, 112 aa, Saccharomyces cerevisiae
MYLSAQLMRTVTASHLTLRALSTPPLFQHRQIAAVEWCGTTRPGLARQKRTQHASSVISKSGVLSAKPSSVFLALLAGKLAEKYIYARMLLFHVSVVNECPVVFHSGPVVWK

SEQ ID NO: 134 - DNA, 1422 bp, Saccharomyces cerevisiae
  CDS (1)..(1422)
atgggtggagaaattattactttgcaagcaggtcaatgcgggaaccacgttggtaagtttctctggtctcaattggcgaaagaacacgctataggcaccgatgggctatctcagcttcctgattccagtacggaaagagatgatgacacaaagcctttcttccgcgaaaacagtaggaataagtttacgccaagggctattatgatggattccgagcctagtgtcatcgccgacgtggagaacacatttcgtgggtttttcgacccaagaaatacctgggtagcttctgatggcgctagcgctggtaattcttgggccaatgggtatgatataggaactcgtaaccaggatgatattcttaacaagatcgacaaggagattgattctaccgacaatttcgaaggtttccagttgctgcactcagtagccggagggaccggttcagggctcggatccaacctcttagaagcgctgtgtgatcgatatcctaaaaaaatactcacgacatattctgtgttccctgcaagatcttctgaggttgttgttcaatcttataacactattctggctttgagaagactgatagaagatagcgatgcaacggtggtgtttgataacgcttcgttgctgaatatttccggtaaagtgtttagaaatccgaacatcgatttacaacacacgaatcaattgatatcgaccataatatcttcagtaacgaacagtatacggtttccgagttacatgtattcatccatgtccagtatttactctaccttgattccttctcctgaacttcatttcctaagccctagtttcactccatttacatcagattatattcacgatgatatagcgcataaaggccattccagttatgacgtcatgttagatttattagacccttccaattctcttgtctctaccgcgatgaacaatccaacatattttaacgtttataatacaatcattggtaatgtagaacctcgtcagatatcgcgtgctatgaccaaattacaacaacgcatcaaattcccctcatggtcctcttctgcgatgcacgttaacattggaagaagatcgccatacttgcctttacaaccaaatgaaaacgaagttagcggcatgatgttaagcaatatgtctaccgtggtgaacgtctttgagaatgcgtgcaatacttttgacaaagtatttgccaagggcgcatttttaaataattataatgtaggcgacttgttccaatcaatgcagaacgttcaagatgaattcgccgagtcaagagaagtagtacaaagcctgatggaggattatgtagctgcagaacaagattcgtacttggacgatgtacttgttgatgatgaaaatatggttggcgagttggaagaggacctggatgccgacggtgatcataaattagtataa

SEQ ID NO: 135 - protein, 473 aa, Saccharomyces cerevisiae
MGGEIITLQAGQCGNHVGKFLWSQLAKEHAIGTDGLSQLPDSSTERDDDTKPFFRENSRNKFTPRAIMMDSEPSVIADVENTFRGFFDPRNTWVASDGASAGNSWANGYDIGTRNQDDILNKIDKEIDSTDNFEGFQLLHSVAGGTGSGLGSNLLEALCDRYPKKILTTYSVFPARSSEVVVQSYNTILALRRLIEDSDATVVFDNASLLNISGKVFRNPNIDLQHTNQLISTIISSVTNSIRFPSYMYSSMSSIYSTLIPSPELHFLSPSFTPFTSDYIHDDIAHKGHSSYDVMLDLLDPSNSLVSTAMNNPTYFNVYNTIIGNVEPRQISRAMTKLQQRIKFPSWSSSAMHVNIGRRSPYLPLQPNENEVSGMMLSNMSTVVNVFENACNTFDKVFAKGAFLNNYNVGDLFQSMQNVQDEFAESREVVQSLMEDYVAAEQDSYLDDVLVDDENMVGELEEDLDADGDHKLV

SEQ ID NO: 136 - DNA, 615 bp, Saccharomyces cerevisiae
atgggtgcctacaaatatttggaagaattgcaaagaaagaagcaatctgatgttttgagattcttgcaaagagtcagagtctgggaatacagacaaaagaatgtcattcacagagccgctagaccaactagaccagacaaggctagaagattgggttacaaagctaagcaaggtttcgttatctaccgtgtcagagttagacgtggtaacagaaagagacctgttccaaagggtgctacttacggtaagccaactaaccaaggtgtcaatgaattgaaataccaaagatccttgagagctaccgctgaagaaagagttggtcgtcgtgccgctaacttgagagtcttgaactcctactgggttaaccaagattctacttacaagtacttcgaagttatcttggtcgaccctcaacacaaggctatcagaagagatgctcgttacaactggatctgtgacccagttcacaagcaccgtgaagctagaggtttgactgccactggtaagaaatccagaggtatcaacaagggtcacaaattcaacaacaccaaggctggtagaagaaagacctggaagagacaaaacactttgtccttgtggagatacagaaaataa

SEQ ID NO: 137 - DNA, 801 bp, Saccharomyces cerevisiae
  CDS (1)..(801)
atgttgaacgtgctattgagaaggaaggccttttgtttggtgacgaagaagggtatggctactgccacaacagctgcagctacgcatacccccagattgaaaacttttaaagtttacagatggaatccagacgagccaagtgctaaacctcatttacagtcatatcaagtggatctgaatgactgtgggcccatggtacttgatgcgctgttaaagatcaaagacgaacaggattctaccctaacttttagaagatcatgtagagaaggtatctgcggttcatgtgccatgaacattggcggtagaaacacgctagcttgtatatgtaagatcgaccagaacgaatccaaacaactcaagatctatccattaccccacatgtttattgtcaaagatttggtacctgatttaactaacttctaccaacaatacaaatctatccaaccttacttacagagatcatcgtttccaaaggatggaacggaagtgctacaaagtattgaagatcgtaagaaactggatggtctttacgaatgtattctgtgtgcatgctgctctacttcatgtccatcgtactggtggaaccaagaacagtatttgggccctgccgtgctaatgcaagcctaccgttggctaattgactctagagaccaagctacaaagacaagaaaggccatgctaaacaactccatgtcattgtacagatgtcacaccatcatgaactgtactagaacttgtccaaagggcttgaatcctggtttggctattgctgaaattaagaaatctttggcatttgcctag

SEQ ID NO: 138 - protein, 266 aa, Saccharomyces cerevisiae
MLNVLLRRKAFCLVTKKGMATATTAAATHTPRLKTFKVYRWNPDEPSAKPHLQSYQVDLNDCGPMVLDALLKIKDEQDSTLTFRRSCREGICGSCAMNIGGRNTLACICKIDQNESKQLKIYPLPHMFIVKDLVPDLTNFYQQYKSIQPYLQRSSFPKDGTEVLQSIEDRKKLDGLYECILCACCSTSCPSYWWNQEQYLGPAVLMQAYRWLIDSRDQATKTRKAMLNNSMSLYRCHTIMNCTRTCPKGLNPGLAIAEIKKSLAFA

SEQ ID NO: 139 - DNA, 1134 bp, Saccharomyces cerevisiae
  CDS (1)..(1134)
atgtctaaagggagggtcaatcagaagcgttacaagtatcctcttccaattcaccccgtagatgaccttccagagttaatccttcataatccgttatcttggctatattgggcataccgctattacaagagtacgaacgcactgaacgataaagtacatgtagattttataggagataccactcttcacatcacggttcaagatgacaagcaaatgctatatctttggaataatggattttttggcactggtcaatttagcaggagtgagcctacatggaaagctagaacagaggccagactgggtctcaatgatactcccctccacaatcggggaggaacaaagagtaatactgaaacggagatgactttagagaaggtcacacaacagaggagattacaaagattagagttcaagaaagaacgtgcgaagttagaaagagaattactagaattaagaaaaaaaggtggtcatatcgatgaggaaaacatcctccttgagaaacaacgagaatcattaagaaaatttaaactaaaacaaacagaagacgtgggcatcgttgcacaacagcaagacatttccgaatcaaatttaagagatgaagacaacaatcttcttgatgagaacggtgatcttttgccactagagtcactagaactaatgccagtggaagctatgtttttaacttttgcacttcctgttcttgacatatctcccgcgtgcctggcagggaaactgtttcaattcgatgccaaatataaagatattcactcctttgtcagatcatacgttatataccatcactacagatcacacggttggtgcgtaagatctggtataaaattcggctgcgattatttattatataagagagggccaccatttcaacacgctgaattttgtgttatgggtcttgaccacgacgtctctaaagattatacgtggtattctagcatagcccgtgttgtgggcggcgcaaagaagacgtttgtgttatgctacgtggagagactaatctcggaacaggaggcgatagcactatggaaatcaaacaactttactaaattgttcaatagttttcaagttggtgaagtattgtataagagatgggttcccggaagaaatagagactag

SEQ ID NO: 140 - protein, 377 aa, Saccharomyces cerevisiae
MSKGRVNQKRYKYPLPIHPVDDLPELILHNPLSWLYWAYRYYKSTNALNDKVHVDFIGDTTLHITVQDDKQMLYLWNNGFFGTGQFSRSEPTWKARTEARLGLNDTPLHNRGGTKSNTETEMTLEKVTQQRRLQRLEFKKERAKLERELLELRKKGGHIDEENILLEKQRESLRKFKLKQTEDVGIVAQQQDISESNLRDEDNNLLDENGDLLPLESLELMPVEAMFLTFALPVLDISPACLAGKLFQFDAKYKDIHSFVRSYVIYHHYRSHGWCVRSGIKFGCDYLLYKRGPPFQHAEFCVMGLDHDVSKDYTWYSSIARVVGGAKKTFVLCYVERLISEQEAIALWKSNNFTKLFNSFQVGEVLYKRWVPGRNRD

SEQ ID NO: 141 - DNA, 1182 bp, Saccharomyces cerevisiae
  CDS (1)..(1182)
atgtcatcaagaataattgtcggcagtgcagcattggcagctgccatcacagctagcatcatggtcagagaacagaaggccaagggtcagagaagagagggcaacgtctccgcttactacaacggccaggagtacggcagttcagcacccccacagttgggaaagctacataacataaagcaaggcataaaggaagatgccttgtcgttaaaagacgcgcttctgggcgtatctcaaaaggctagggaagaggctccaaaggtaactaagcgtgtgatatcaccggaagaggatgctcagacacgcaagcagctaggccaaaaagccaaggattcttcctcgcaaagcatcttcaattgggggtttagtgaggctgaaagaaggaaagccatagccatcggggaatttgatactgctaagaagcgtttcgaagaggcagtggatcgtaatgagaaggagctcttgtccacggtgatgagagagaagaaggccgctctggacagagcatccattgagtacgaaaggtacgggagagccagagactttaatgagctttcggacaagctagaccaacaggaaaggaacagtaatcctttgaaacgcctgttgaagaataacacgggtgacgctaatactgaagaagccgctgcaagaagtgtccaaggctggggtgatacggcacaggagtttggtagagaagagttggaggaagccaagagaaatgcttcttcagagccaagcgaggcgcaaaaacgtcttgacgagctgaagaagatcaaggaaaagggctggtttggttacaacaaaggggagcaaagcgagcaacagattgctgaacgggtagccagaggtttagaaggatggggtgaaacagccgctcaactttccaaggacgaaatggacgatttaagatggaattatgagaattcaaagaaacaactggataagaacgtgtccgatgccatggactcgttatctaaggcgaaggaggacttgaaacagtacggcagccactggtggtctggatggacttccaaggtcgacaatgacaagcaggctttaaaagatgaggcccaaaagaagtacgatgaagcgttgaaaaagtacgatgaagccaagaacaaattcaaagaatggaatgataagggtgatggtaaattctggagctcgaaaaaggactag

SEQ ID NO: 142 - protein, 393 aa, Saccharomyces cerevisiae
MSSRIIVGSAALAAAITASIMVREQKAKGQRREGNVSAYYNGQEYGSSAPPQLGKLHNIKQGIKEDALSLKDALLGVSQKAREEAPKVTKRVISPEEDAQTRKQLGQKAKDSSSQSIFNWGFSEAERRKAIAIGEFDTAKKRFEEAVDRNEKELLSTVMREKKAALDRASIEYERYGRARDFNELSDKLDQQERNSNPLKRLLKNNTGDANTEEAAARSVQGWGDTAQEFGREELEEAKRNASSEPSEAQKRLDELKKIKEKGWFGYNKGEQSEQQIAERVARGLEGWGETAAQLSKDEMDDLRWNYENSKKQLDKNVSDAMDSLSKAKEDLKQYGSHWWSGWTSKVDNDKQALKDEAQKKYDEALKKYDEAKNKFKEWNDKGDGKFWSSKKD

SEQ ID NO: 143 - DNA, 1083 bp, Saccharomyces cerevisiae
  CDS (1)..(1083)
atgtcctcacaagaatatacaacttttatagatataccagtgacaagagcgcaggttgaacactgttcttactcgttttggtcctcactgtatcccaaatatgtgccaaaatccatagtgttaaaatccttaccgaaaaaatttattcaatatttggaacaagacggtatcaagctaccccaagaggaaaactccaggtctgtgtacaccgaggaaataataagaaatgaagataatgactatagtgattgggaggacgatgaggataccgccaccgaatttgtccaagaagttgagccattgatagattttccagaattacaccagaaattaaaggatgctttgaacgaattaggtgcagtggctcccaagttaaactggtctgcaccaagagacgctacctggattttgccgaataacactatgaagtgtaacgaggtaaatgagctttacctattgttgaacgcatccaattacataatgcatgaccttcaaagagcatttaaaggctgcgtggacggggatgatataaaaggattgaaatttgacttggtacttagacaatggtgtgatatgaatccggcactcgaatttagggtcttcgttaagaatgcgcatatcgttggggccacccagcgtgatttaaattattatgactatttagatgagttgtcagataccttcaaggaccttattgatgaaatagttcatgatgtcgtcctgcccaagtttcctgataaaagtttcgttcttgacgtttatattccaagacctttcaataaaatcttcattgttgatataaatccgtttgccaggaagacagattctttgctattttcatggaacgagattgctgcgatagcacctccgaagaatgatgttgaagattatgaattaaggttagtgacgaggcataacacggggagattcgcttcaaaagagcactccgaaaatcatgttccacaggatctcgtagaagctagtttaaatcctgaagcaatccgagagctcactcaaaaatggaaagaactactctctcaacaggcaaaggaagaaagcagtgatagtgagaatgaaacttag

SEQ ID NO: 144 - protein, 360 aa, Saccharomyces cerevisiae
MSSQEYTTFIDIPVTRAQVEHCSYSFWSSLYPKYVPKSIVLKSLPKKFIQYLEQDGIKLPQEENSRSVYTEEIIRNEDNDYSDWEDDEDTATEFVQEVEPLIDFPELHQKLKDALNELGAVAPKLNWSAPRDATWILPNNTMKCNEVNELYLLLNASNYIMHDLQRAFKGCVDGDDIKGLKFDLVLRQWCDMNPALEFRVFVKNAHIVGATQRDLNYYDYLDELSDTFKDLIDEIVHDVVLPKFPDKSFVLDVYIPRPFNKIFIVDINPFARKTDSLLFSWNEIAAIAPPKNDVEDYELRLVTRHNTGRFASKEHSENHVPQDLVEASLNPEAIRELTQKWKELLSQQAKEESSDSENET

SEQ ID NO: 145 - DNA, 1281 bp, Saccharomyces cerevisiae
  CDS (1)..(1281)
atgtcgcaccaaaaccagcttattccacaagcttatatttctaactttcataacagattgacaaacgaagatgatggtatccccatctttacaatggctcaacaaacaaggcagcataaaagggctaaagtggtcaactatgcggaatatgacaacgatctctttgatgaattcaatatgaacggttctaatttcaacaatgctgatacacactataaagataatgcagtgtctcatgaaaatactccggcacttacaaatggtgttaccatggacggttccgaatacaatgtcctagagaacatgaatggagctgatagtattatctctaacaacaaatacgatgcgggttcaaacatggttgtggaatctttatccggtttgaatagcaataacaacgccagcaatggtccgagcaacaaagcgcaggcacaggatattggaaacgccgttctaccggatctgcaagaccaacaccacaaccccttcaacatattgagataccctaaaataagagatactttcattaacggaaaagtggtgtctccatatagactcaacactgatcaagaaacgaaggcaaacgccaattctggagaggcaatcatgataccaattactttggatatagaacatatgggtcataccataaaagaccagtttctctggaactacaatgacgactccatatctccggaggaatttgcctctatatactgtaaagatcttgatatgacttccgctaccttacaaactcaaattgcgaatataataaaagagcagttgaaagacctcgaaaatattgcagccactgagataatgtctgacctccacgtgataatcaacctaacctgcaacttacaagacagattttttgaagataacttccagtggaacttgaacgacaaatcacttactccagaaagatttgctacatccattgtacaggaccttggcttaacaagagagttcatccccttaatatctcaatcgcttcatgaaactatcttgaagataaagaaggactgggtagatggccacttgattcaggaccatgtcccaaacgatgccgcatttgggtacttatctggtataaggctggatattgatgaactgggctccaattggtgcccaagggtggaaatattaacaaaagaagaaatacaaaagagagaaattgaaaaagaaagaaacttaagaagattgaaaagagaaactgatagattatctagaaggggcaggagaagattagatgacttagaaaccacaatgagaatgtag

SEQ ID NO: 146 - protein, 426 aa, Saccharomyces cerevisiae
MSHQNQLIPQAYISNFHNRLTNEDDGIPIFTMAQQTRQHKRAKVVNYAEYDNDLFDEFNMNGSNFNNADTHYKDNAVSHENTPALTNGVTMDGSEYNVLENMNGADSIISNNKYDAGSNMVVESLSGLNSNNNASNGPSNKAQAQDIGNAVLPDLQDQHHNPFNILRYPKIRDTFINGKVVSPYRLNTDQETKANANSGEAIMIPITLDIEHMGHTIKDQFLWNYNDDSISPEEFASIYCKDLDMTSATLQTQIANIIKEQLKDLENIAATEIMSDLHVIINLTCNLQDRFFEDNFQWNLNDKSLTPERFATSIVQDLGLTREFIPLISQSLHETILKIKKDWVDGHLIQDHVPNDAAFGYLSGIRLDIDELGSNWCPRVEILTKEEIQKREIEKERNLRRLKRETDRLSRRGRRRLDDLETTMRM

SEQ ID NO: 147 - DNA, 462 bp, Saccharomyces cerevisiae
  CDS (1)..(462)
atgggtaagaaaaacactaaaggtggtaaaaaaggtagaagaggtaagaacgactctgacggtccaaagcgtgaacttatttataaggaagaaggccaagaatatgctcaaatcaccaagatgttgggtaatggaagagtcgaagccagttgctttgatggtaataagagaatggcccatattagaggtaagttaagaaagaaagtctggatgggacaaggtgatattattcttgtttccttaagagatttccaagatgaccaatgtgatgttgtccacaaatataatttagatgaagccagaacactgaaaaaccaaggtgaacttcctgaaaacgccaaaattaatgaaacagacaactttggtttcgaatctgatgaagacgttaactttgaatttggtaacgctgatgaagatgatgaggaaggtgaagatgaagaacttgatattgatgacatttaa

SEQ ID NO: 148 - protein, 153 aa, Saccharomyces cerevisiae
MGKKNTKGGKKGRRGKNDSDGPKRELIYKEEGQEYAQITKMLGNGRVEASCFDGNKRMAHIRGKLRKKVWMGQGDIILVSLRDFQDDQCDVVHKYNLDEARTLKNQGELPENAKINETDNFGFESDEDVNFEFGNADEDDEEGEDEELDIDDI

SEQ ID NO: 149 - DNA, 486 bp, Saccharomyces cerevisiae
  CDS (1)..(486)
atgataaaagtcgatacttccgatgcattgttgaaaaattcgttaacatcaataaaatggacattaaatatgttggatattttattcagttgtgacattttttcattaatcaaggattccatacgttctttgataacagaaacattttcctcggtgaataccgtgagtacatcgacggtaaagcctgtacgattattgtgttgcttagtttgttccaatagcaagtcgtgcacaatatctaacataaccagagatcctgaatcagaatgtgataaggggagcagaatcttagagacggatccttctttttcaaatgggtatataactttaaataggttcctgaaatattcatccttcatcatttgtttcctttgtttagtactaacaaacttgatgaaacattcatcgcaaaacttttcctttctagactcaactgtcgctggatttctggcagatgcagggcacctctggcactccataacttga

SEQ ID NO: 150 - protein, 161 aa, Saccharomyces cerevisiae
MIKVDTSDALLKNSLTSIKWTLNMLDILFSCDIFSLIKDSIRSLITETFSSVNTVSTSTVKPVRLLCCLVCSNSKSCTISNITRDPESECDKGSRILETDPSFSNGYITLNRFLKYSSFIICFLCLVLTNLMKHSSQNFSFLDSTVAGFLADAGHLWHSIT

SEQ ID NO: 151 - DNA, 690 bp, Saccharomyces cerevisiae
  CDS (1)..(690)
atgactgtttctacttccaagaccccaaaaaagaatattaagtataccttaacacatactttacaaaaatggaaagaaactttaaagaaaattacccacgaaacgttgagtagtatcgatgactctagtggaagcgatgaaaaaatagaggctctgtttactgtgtctcagcctgccgtcgtagcctccaagggtatagacagagatagtggtgcttctatgtcgcaggtaggaggaggtgtcaatagtacattggagatgaagctcacagatgagagtgaggaatctagctctgctaataacacgaccacaaccgcctcgcatactctatcgaattcgaagaagtctacgcagaactttgaaaactataacgtagtggaggaacgcataaaattagcacagaaaagtaaggcgccgttttgtaacgctgagaaaatctggaaacgaagaagacaactctggacacaacccactgagcaaagtgaaagcgccaataatgacggagttactcgaagggagattttccaagctatacctcaggaatattatgctcgagtttacaagaaactggtggtagatgataagccattgagagagcctctaaatctggaagatgctttacaagtcataaatgcaggctggacggaaacgagaaagtgggctaatgctgccaaggcatgccatgactga

SEQ ID NO: 152 - protein, 229 aa, Saccharomyces cerevisiae
MTVSTSKTPKKNIKYTLTHTLQKWKETLKKITHETLSSIDDSSGSDEKIEALFTVSQPAVVASKGIDRDSGASMSQVGGGVNSTLEMKLTDESEESSSANNTTTTASHTLSNSKKSTQNFENYNVVEERIKLAQKSKAPFCNAEKIWKRRRQLWTQPTEQSESANNDGVTRREIFQAIPQEYYARVYKKLVVDDKPLREPLNLEDALQVINAGWTETRKWANAAKACHD

SEQ ID NO: 153 - DNA, 654 bp, Saccharomyces cerevisiae
  CDS (1)..(654)
atgagttccctattaatatcatacgaatctgacttcaaaacaaccttagaacaagccaaagcgagcttagcagaggccccctcacaaccgttatcacagagaaatactacactgaagcacgtagaacagcaacaagatgagttgtttgacctgctagatcagatggatgtagaagttaataacagcataggcgatgcctcagaacgtgctacgtacaaggcgaagttaagagaatggaagaagactatacagagcgatatcaaacgaccactgcaatccttagtagactcaggcgatcgtgatagactttttggagatcttaacgcatctaatattgacgatgaccaaaggcaacagttgttgagcaaccatgcaatcttacagaaatcgggagatagactaaaagatgccagtagaatagcaaatgaaactgaaggaatagggtcacaaataatgatggatttaaggtcacagagagaaactttggaaaatgcaagacagaccttgtttcaagcggattcatatgtggataaaagtataaagacactaaaaacaatgactagaaggctagttgctaataaattcataagctatgccattatcgcagtccttatattattgattttgctagttttgttctcaaagtttaaataa

SEQ ID NO: 154 - protein, 217 aa, Saccharomyces cerevisiae
MSSLLISYESDFKTTLEQAKASLAEAPSQPLSQRNTTLKHVEQQQDELFDLLDQMDVEVNNSIGDASERATYKAKLREWKKTIQSDIKRPLQSLVDSGDRDRLFGDLNASNIDDDQRQQLLSNHAILQKSGDRLKDASRIANETEGIGSQIMMDLRSQRETLENARQTLFQADSYVDKSIKTLKTMTRRLVANKFISYAIIAVLILLILLVLFSKFK

SEQ ID NO: 155 - DNA, 1863 bp, Saccharomyces cerevisiae
  CDS (1)..(1863)
atgagagactctaatcatcgatcattaacgtcgaacaagcctatagtaacaataacatctactgtctatgaccgaagggcattggatatcaactctagtattccgttaataaactccctaaactacttaacatatctaacctctaattcatcaaaagttagggaaacggtagctaacgacggtgctctcgaaagattagtctcaatattgaggagttgtcatttaagtttgtttgagttgctggatttggatttagaaaattttaatgagcacgaaaacataaaggatctatggaaggagaaaagactagcactatgcgcttggaaatggactttaacatttcagtgcttagtattgacaggtactagagggacagaacaaattcgtaaaaaagtggtaatgtctggggtcttatctgtgctggtcacagtattggataactatttactatatcataaaaattacgacttcatcaaagatcaaacaatgacctttgacttcaaagggataaccacggagacaatgtataaattcatgagaaaagatgagaatgaaacatatcagcagtatatagagttcattacaggtcaggataaattgaagttgtcaactgacaaaaattttctaaacgaacgattagtggcaccgtctatgacaattccaactgattttagtgatatatggggccggtttgcagacctagctagcaattttgaacctgaccaggaaagacacgacgacgacattgatattgatagtgaagtagaaagtgaaaattttgatgcacataagaatttcttttcgcaaccagacattaatagacctacaatttccactccacgtgaattttttctcggaagaattgtccccaaacaagacgacgttatatggtcgcttcagttattagcttttgtttcgaagtatacatatatgaaatcaacccttcaaaatgttgagctggttgaatccctatcgttcagaagtatggcttacaaaattaaacagagaatctcagaagagaatgacttagaagaacaagaaagagacgtaactgtaaaattgtcttcattatatccttatttatcgaaaaatcctgaaaacaattccaaagttaaggcactagatactagcaaaatggatccatttttcaaagaattagaagaactctcaaacagatgtcaacaagaagaacaaaatgaaatatgtaataaccactgtcccgttcttaatttgtttgagcgctaccgtgtaccgaaacctagcgacgacaatgcctatggcaaagacaaggaaagaattaatttaaggaagaaaatatctgataactttgaaaggcgctggagctacgataaaatgaaaaaggaattaacaaatattgtttacaaaaacaaggtactaacaaatgttgtaaacatcttccccttagtcgaaaaatatacagtgagcgcagaaaatacacatgatgttatatattggagttctgtcatcatgagaaattcatgtcgaaaaaatgagatcttaggtgtgcgtcagtgtgccaatttttcgtgcggaaaatgggaagattttccaagacaatttgcaaaatgtcgtcgatgcaaaagaacgaaatattgctcacgaaagtgtcaattaaaagcatggggatatcataggtattggtgtcacgaagttggatcaagtcatatgagatccacgaatactaccacaggtgtcaataccccaaatgagcctagttctttaaatgccaccgctactacagcagctgatgtttcgaattctaccagtacgttcactcctaatatatccaccaccgtacctgatgaaataagcaatagggatgaaaatagcatacctgagtaa

SEQ ID NO: 156 - protein, 620 aa, Saccharomyces cerevisiae
MRDSNHRSLTSNKPIVTITSTVYDRRALDINSSIPLINSLNYLTYLTSNSSKVRETVANDGALERLVSILRSCHLSLFELLDLDLENFNEHENIKDLWKEKRLALCAWKWTLTFQCLVLTGTRGTEQIRKKVVMSGVLSVLVTVLDNYLLYHKNYDFIKDQTMTFDFKGITTETMYKFMRKDENETYQQYIEFITGQDKLKLSTDKNFLNERLVAPSMTIPTDFSDIWGRFADLASNFEPDQERHDDDIDIDSEVESENFDAHKNFFSQPDINRPTISTPREFFLGRIVPKQDDVIWSLQLLAFVSKYTYMKSTLQNVELVESLSFRSMAYKIKQRISEENDLEEQERDVTVKLSSLYPYLSKNPENNSKVKALDTSKMDPFFKELEELSNRCQQEEQNEICNNHCPVLNLFERYRVPKPSDDNAYGKDKERINLRKKISDNFERRWSYDKMKKELTNIVYKNKVLTNVVNIFPLVEKYTVSAENTHDVIYWSSVIMRNSCRKNEILGVRQCANFSCGKWEDFPRQFAKCRRCKRTKYCSRKCQLKAWGYHRYWCHEVGSSHMRSTNTTTGVNTPNEPSSLNATATTAADVSNSTSTFTPNISTTVPDEISNRDENSIPE

SEQ ID NO: 157 - DNA, 1350 bp, Saccharomyces cerevisiae
  CDS (1)..(1350)
atgcgtctaaaagaattgttacctaattttttgattgttcatcaagaggtccctgaggatcctattgcattcaagtccaccgataaacgagagaatgaaaataaagagatcaccatccctgagctaatagatactaaagttcctgaattagctgacggtgctactgacactttatatggtttactggtcaatggccatttacaaactgcatatggttcctttagacactttgacaatatatacaaagttcaatataaaagaatgataatcaaatacccacatgggggagaagggactgtggattttgctgtaaatggtagaagtaccaaaagaagaaaagtggaaaaagaatacgtgccgacaagtcaaccggtatttaacggaaacttgaaacgaagatattcgtactattcccctgatgatcctaaattgaactcagacgatgctaagcctatgcttattattctccatggattaacagggggttcgagggaaagctacgtgagggcaattgttcatgaaatcaccacgaagtatgactttgaagcatgcgtgtttaatgctagaggatgttgttattctgcaattacaacgccgctattatacaacggtggttggaccaatgatataagatattgtgttaatgacttgaggaaaagatttccgaatagaaagttttatatgatgggattttcgttaggcgcatctataatgacaaattacttgggagaagagtcagatcgtactaaaatcgaatgtgctatttccgtgagtaatccatttgacctgtacaactctgcatattttattaacagtacaccaatggggtcacgattttattcacctgctttgggtcacaacttactacgcatggttcgaaaccatctctctactctggaagaaaaccctgatttcaaagatgttatcgagaagcatttaaaaaagattcgcactgtgaggcaatttgataacttgttgacaggcccaatgtttggatataaaaatgcagaggagtattacaagaatgcttcatcatataaaagaatacccgggatcagaactccttttatagctttgcatgctcaggatgacccaattgtcggaggtgatcttcctatagaccaaataaaatccaatccatacactttgcttctagaaacttcgacgggggggcatgttggatggttcaaagacagatccggcagaaggtggtacgcagaacccttatgcagatttttgaaaatatttcacgacgaaattactgtaaagggcttaaaacctgacttggaaaatgttcaactcccagatcctaattgcgaacccatagccacaacctttcgcgcgaattag

SEQ ID NO: 158 - protein, 449 aa, Saccharomyces cerevisiae
MRLKELLPNFLIVHQEVPEDPIAFKSTDKRENENKEITIPELIDTKVPELADGATDTLYGLLVNGHLQTAYGSFRHFDNIYKVQYKRMIIKYPHGGEGTVDFAVNGRSTKRRKVEKEYVPTSQPVFNGNLKRRYSYYSPDDPKLNSDDAKPMLIILHGLTGGSRESYVRAIVHEITTKYDFEACVFNARGCCYSAITTPLLYNGGWTNDIRYCVNDLRKRFPNRKFYMMGFSLGASIMTNYLGEESDRTKIECAISVSNPFDLYNSAYFINSTPMGSRFYSPALGHNLLRMVRNHLSTLEENPDFKDVIEKHLKKIRTVRQFDNLLTGPMFGYKNAEEYYKNASSYKRIPGIRTPFIALHAQDDPIVGGDLPIDQIKSNPYTLLLETSTGGHVGWFKDRSGRRWYAEPLCRFLKIFHDEITVKGLKPDLENVQLPDPNCEPIATTFRAN

SEQ ID NO: 159 - DNA, 1083 bp, Saccharomyces cerevisiae
  CDS (1)..(1083)
atgtcttatcctgagaaatttgaaggtatcgctattcaatcacacgaagattggaaaaacccaaagaagacaaagtatgacccaaaaccattttacgatcatgacattgacattaagatcgaagcatgtggtgtctgcggtagtgatattcattgtgcagctggtcattggggcaatatgaagatgccgctagtcgttggtcatgaaatcgttggtaaagttgtcaagctagggcccaagtcaaacagtgggttgaaagtcggtcaacgtgttggtgtaggtgctcaagtcttttcatgcttggaatgtgaccgttgtaagaatgataatgaaccatactgcaccaagtttgttaccacatacagtcagccttatgaagacggctatgtgtcgcagggtggctatgcaaactacgtcagagttcatgaacattttgtggtgcctatcccagagaatattccatcacatttggctgctccactattatgtggtggtttgactgtgtactctccattggttcgtaacggttgcggtccaggtaaaaaagttggtatagttggtcttggtggtatcggcagtatgggtacattgatttccaaagccatgggggcagagacgtatgttatttctcgttcttcgagaaaaagagaagatgcaatgaagatgggcgccgatcactacattgctacattagaagaaggtgattggggtgaaaagtactttgacaccttcgacctgattgtagtctgtgcttcctcccttaccgacattgacttcaacattatgccaaaggctatgaaggttggtggtagaattgtctcaatctctataccagaacaacacgaaatgttatcgctaaagccatatggcttaaaggctgtctccatttcttacagtgctttaggttccatcaaagaattgaaccaactcttgaaattagtctctgaaaaagatatcaaaatttgggtggaaacattacctgttggtgaagccggcgtccatgaagccttcgaaaggatggaaaagggtgacgttagatatagatttaccttagtcggctacgacaaagaattttcagactag

SEQ ID NO: 160 - protein, 360 aa, Saccharomyces cerevisiae
MSYPEKFEGIAIQSHEDWKNPKKTKYDPKPFYDHDIDIKIEACGVCGSDIHCAAGHWGNMKMPLVVGHEIVGKVVKLGPKSNSGLKVGQRVGVGAQVFSCLECDRCKNDNEPYCTKFVTTYSQPYEDGYVSQGGYANYVRVHEHFVVPIPENIPSHLAAPLLCGGLTVYSPLVRNGCGPGKKVGIVGLGGIGSMGTLISKAMGAETYVISRSSRKREDAMKMGADHYIATLEEGDWGEKYFDTFDLIVVCASSLTDIDFNIMPKAMKVGGRIVSISIPEQHEMLSLKPYGLKAVSISYSALGSIKELNQLLKLVSEKDIKIWVETLPVGEAGVHEAFERMEKGDVRYRFTLVGYDKEFSD

SEQ ID NO: 161 - DNA, 858 bp, Saccharomyces cerevisiae
  CDS (1)..(858)
atgcgttcttcggtatatagtgagaacacttacaactgtatacgaacatcgaaggagcacctaacagaaagaaggagggtcgccatggcgccaatgttccaacatttcttaaacttatgcgtggaaaaatttcctgaatccatcgagcacaaggatacagatggaaacggtaacttcaccaccgctattttagaaagggagattatctacatccccgaagatgacactgacagtattgacagcgttgacagcctcaagtgtataaactacaagctgcacaaatctcgcggcgaccaagtgctggacgcctgtgtgcaattgatagacaagcacctgggcgccaagtatcgccgggcctcgcgcattatgtacggcaacaggaaaccatggaaggcaaacaaactcgcagagatgaaaagcgccggccttgtgtatgtctgttactgggacaacggcgtgctaggtgcatttacttcattcatgcttacagaggagacgggtctcgtcgaaggtgacgctttacacgaggttagcgtgcccgtgatatacctttacgaagtacatgtagctagcgcgcaccgcgggcatggaatcggtcggcggctactggagcatgcactgtgcgatggcgtagctcgacacacccgccgcatgtgcgacaatttcttcggtgtagcactcaccgtattcagtgataacactcgggcccggcgactatatgaggcgcttgggttctaccgcgctccgggatcacccgcaccagcatcacccacaattcgtcacacgcgacatggtgggggacgtgtagtcgtgccctgcgatccgctttattacgtatattgccttcacatgccgtga

SEQ ID NO: 162 - protein, 285 aa, Saccharomyces cerevisiae
MRSSVYSENTYNCIRTSKEHLTERRRVAMAPMFQHFLNLCVEKFPESIEHKDTDGNGNFTTAILEREIIYIPEDDTDSIDSVDSLKCINYKLHKSRGDQVLDACVQLIDKHLGAKYRRASRIMYGNRKPWKANKLAEMKSAGLVYVCYWDNGVLGAFTSFMLTEETGLVEGDALHEVSVPVIYLYEVHVASAHRGHGIGRRLLEHALCDGVARHTRRMCDNFFGVALTVFSDNTRARRLYEALGFYRAPGSPAPASPTIRHTRHGGGRVVVPCDPLYYVYCLHMP

SEQ ID NO: 163 - DNA, 1755 bp, Saccharomyces cerevisiae
  CDS (1)..(1755)
atgtcgcgggaggcatttgatgtaccgaatataggtactaacaagtttttaaaagtcacacctaatttatttaccccagagcgattgaatttatttgatgatgtcgaactatatcttacgttaataaaagcatccaaatgtgtcgagcagggagaaaggctgcacaatataagttggagaattctgaataaagctgttctaaaggagcataatattaatcgatctaaaaaaagagacggcgtgaagaacatatattatgtgttaaatccaaacaacaaacagccaataaagccaaagcaggcagcagtaaagcagccaccattacaaaaggccaatttgcctcccacaacggcaaaacagaacgttttaactcggccaatgacatcaccagctatcgcacagggtgctcacgatagatccttggataatcctaattctacaaacaatgatgtgaaaaatgacgttgctccaaacagacaattctccaaatctactacgtcagggttgttttcaaattttgcagacaaatatcaaaaaatgaaaaatgtgaaccatgttgctaataaggaagaaccacaaactattatcactggttttgatacaagcactgttataaccaagaaacctttacaatcaagacgctcaagatcacctttccagcatataggagacatgaacatgaactgcattgataatgagacttccaagagtaccagtcctactcttgaaaatatgggaagtagaaaatcctcttttcctcagaaggaatctttattcggaaggccaaggtcttacaagaatgaccaaaatggtcaactgtcactttcgaaaacatcctctagaaaaggaaaaaacaagatatttttcagcagtgaagatgaagattccgattgggacagcgtttcgaatgattcagaattctacgctgatgaagatgatgaagagtacgatgattataatgaggaagaagcagatcagtactatagaagacaatgggacaagcttttatttgccaaaaatcaacagaatcttgactcaacgaaatcatctgtttcatcagcgaacacaatcaactcaaacacatcccatgatcccgtacgaaaaagtttactcagtggactattccttagtgaggcaaatagcaacagtaataaccacaatactgcacatagtgaatacgcttctaaacacgtttcgccgactcctcagtcctctcatagtaatatcggtcctcaaccgcagcaaaatccaccgagcgctaatggtataaaacaacaaaaaccttctttgaaaacaagcaacgtgacagctctagcatcgctatctcccccgcaaccatccaacaatgagcggttatcgatggatatacaaaaggacttcaaaactgataatgagtccaatcatttatatgaatctaatgctccgctaactgctcaaactatactgcccaccgccttatctactcacatgtttttgccaaataacattcaccaacaacgaatggcgattgccactggtagtaatacgcgacatcgtttttcgaggcggcagtcgatggatatcccatccaagaacaggaatactgggtttttgaagaccagaatggagatctctgaggaagaaaagatggtacgtacaatatcacggcttgacaatacgagtattgcaaacagtaatggaaatggtaatgatgacacctctaatcagagaacggaagcactggggcgtaagacgagtaatggagggcgaatatga

SEQ ID NO: 164 - protein, 584 aa, Saccharomyces cerevisiae
MSREAFDVPNIGTNKFLKVTPNLFTPERLNLFDDVELYLTLIKASKCVEQGERLHNISWRILNKAVLKEHNINRSKKRDGVKNIYYVLNPNNKQPIKPKQAAVKQPPLQKANLPPTTAKQNVLTRPMTSPAIAQGAHDRSLDNPNSTNNDVKNDVAPNRQFSKSTTSGLFSNFADKYQKMKNVNHVANKEEPQTIITGFDTSTVITKKPLQSRRSRSPFQHIGDMNMNCIDNETSKSTSPTLENMGSRKSSFPQKESLFGRPRSYKNDQNGQLSLSKTSSRKGKNKIFFSSEDEDSDWDSVSNDSEFYADEDDEEYDDYNEEEADQYYRRQWDKLLFAKNQQNLDSTKSSVSSANTINSNTSHDPVRKSLLSGLFLSEANSNSNNHNTAHSEYASKHVSPTPQSSHSNIGPQPQQNPPSANGIKQQKPSLKTSNVTALASLSPPQPSNNERLSMDIQKDFKTDNESNHLYESNAPLTAQTILPTALSTHMFLPNNIHQQRMAIATGSNTRHRFSRRQSMDIPSKNRNTGFLKTRMEISEEEKMVRTISRLDNTSIANSNGNGNDDTSNQRTEALGRKTSNGGRI

SEQ ID NO: 165 - DNA, 741 bp, Saccharomyces cerevisiae
  CDS (1)..(741)
atggagagtatatttggtgggtttggagatctagttgttcctaggccaaaggagcatctcggtcaaacagacctttccttcggtggaaaattattgcctgcattgaaaatttgtgaagatggcggtgaaagtggttgtggcggtaaagtctggatcgctggcgaactgttgtgcgagtacatactcgagaaatcagttgaccatctgctaagtaagacggtcaatggtacgaaacaatttaaaaaagtcttagaattgggtagtggtacaggtttagttggattgtgcgtggggttgttggaaaaaaacacattccacgatggcactaaagtatatgttacggacattgacaagttgataccactattgaaaagaaatatagaactggacgaagttcagtatgaagttcttgcgagggaactttggtggggtgagccgctgtcggcagatttctcacctcaagaaggtgctatgcaagcaaataacgttgatctagttttggcagctgattgtgtgtatctcgaggaagcttttccattactagaaaaaacactacttgatctcactcactgcataaacccacctgtaatcttgatggcttacaagaagagaagaaaagctgataaacattttttcaacaagattaaaagaaattttgacgttcttgaaattacagattttagtaaatttgaacattatcttaaggaaagaacccacttgtttcagcttatcaggaagtaa

SEQ ID NO: 166 - protein, 246 aa, Saccharomyces cerevisiae
MESIFGGFGDLVVPRPKEHLGQTDLSFGGKLLPALKICEDGGESGCGGKVWIAGELLCEYILEKSVDHLLSKTVNGTKQFKKVLELGSGTGLVGLCVGLLEKNTFHDGTKVYVTDIDKLIPLLKRNIELDEVQYEVLARELWWGEPLSADFSPQEGAMQANNVDLVLAADCVYLEEAFPLLEKTLLDLTHCINPPVILMAYKKRRKADKHFFNKIKRNFDVLEITDFSKFEHYLKERTHLFQLIRK

SEQ ID NO: 167 - DNA, 2022 bp, Saccharomyces cerevisiae
  CDS (1)..(2022)
atgtcaacgcactcaaacgactacttttctgcttcttccggaatggtctctgagacatcgtccgaggtttcttcgataaactcttcacagcctgtatcattctctaaggcttctattgctgctccggttccatgctctgatctacacagcaccaagtcgaacgatgcatcgagaaaattgtctattagtaggacgttaactaatcggctcaacgacattaaaaaggctgtcgatgacgacaacttgcagacggaagaaaattccgcagacgttaataaaatattagaatctagatttgacgtggccgatgccattaggctacagcacaatgagtcagtccagtcaaagttaaacatcccagtcacacacaccacgactgcaggcgcctcgttgtcggcaccatcttcctctgctttctctgcttcttctattcaaaatgatactacagaacataaagcttccatggactccaaactcatgaggaatagactatatccggcttccacgaaacactccggtaaggatcttgaggcccaaggaataaccgaattcgagcctgatgaaccgactgtaaaaaaagtattcaccaacaagtctaccgggcagctggaactgccccccgacggtggttatggctgggtcgtgacattctgtgtgttcttgaccatgttttccacgtggggctgcaacgcatccttcggtgtcgaccttgcctactacttaaaccatgatacttaccctggtgcttcgaagtacgattatgccttaattgctggcctaactgtctttctcggtcaactcttatccccccttgtgatggcactgatgagaataattggtctgcggaccaccatgctttttggtgatgctgtaatgcttgccgcatatctcttggcctcctttactaccaagttatggcaattgtatgtcacccaaggttttatggtcggttgttcaatatcactgattttcgttccagcaacaaccgtcttaccaggatggttcttgaaaaaaagagctgtcgcaatgggtgtctcattattgggtaccggtgctggtggtgtcgtttacggtttggctacaaacaaaatgctttctgactttggaaatacccggtggtgccttcgtatcataggcatatcgtgtagcataagtgttctagttgctattgcgctcttaaaagaaagaaaccctacacctgccataggattgaaatcgcctcgggccatgtttgaacagctcaaagcaatgttttcattaaaggttataactaagccatttgtggtacttattgcattatggttcatgttcgcattatttgcctacaatatgatggtttttactttatcttcatacgcaatctcgaaaggattatcatcgcacgacgcttccacattgactgccattttgaacggctcgcaatccatcggaagacctctgatgggtttagcgggagataagtttggtagggcaaacgtaacgatcgtattaaccactttgttaacaatatatatgtttgcgttctggatccccgctcatacgtttgttcaactcatctttttttcaattctagttggctcatgcgttggtgtcgccaacgtcatgaataccgttctgattgccgatatggttaaaccagaagagtttttgcccgcttgggccttcgtcaactactgtggtgcgcctttcttattggtttgtgaggtgattgcccaggcattgacggtggagaaagataagagcaatccttacttacatgcacaaattttttgcggttgctgctttattgccgcactaattttaatttctatccttcgtgaatattctatcaggatgaaattaacggaaagacaagctatgacaaacgagaagttaaaagaatggaaggcaagcgaatacgataccgattctgccgatgaagattggggtaaattaaaagaaagaaagactaaatatgaccttcttttaggtccgggcattaaaaaatacttcctaagaatggtatatccaatgaaggtctag

SEQ ID NO: 168 - protein, 673 aa, Saccharomyces cerevisiae
MSTHSNDYFSASSGMVSETSSEVSSINSSQPVSFSKASIAAPVPCSDLHSTKSNDASRKLSISRTLTNRLNDIKKAVDDDNLQTEENSADVNKILESRFDVADAIRLQHNESVQSKLNIPVTHTTTAGASLSAPSSSAFSASSIQNDTTEHKASMDSKLMRNRLYPASTKHSGKDLEAQGITEFEPDEPTVKKVFTNKSTGQLELPPDGGYGWVVTFCVFLTMFSTWGCNASFGVDLAYYLNHDTYPGASKYDYALIAGLTVFLGQLLSPLVMALMRIIGLRTTMLFGDAVMLAAYLLASFTTKLWQLYVTQGFMVGCSISLIFVPATTVLPGWFLKKRAVAMGVSLLGTGAGGVVYGLATNKMLSDFGNTRWCLRIIGISCSISVLVAIALLKERNPTPAIGLKSPRAMFEQLKAMFSLKVITKPFVVLIALWFMFALFAYNMMVFTLSSYAISKGLSSHDASTLTAILNGSQSIGRPLMGLAGDKFGRANVTIVLTTLLTIYMFAFWIPAHTFVQLIFFSILVGSCVGVANVMNTVLIADMVKPEEFLPAWAFVNYCGAPFLLVCEVIAQALTVEKDKSNPYLHAQIFCGCCFIAALILISILREYSIRMKLTERQAMTNEKLKEWKASEYDTDSADEDWGKLKERKTKYDLLLGPGIKKYFLRMVYPMKV

SEQ ID NO: 169 - DNA, 1569 bp, Saccharomyces cerevisiae
  CDS (1)..(1569)
atgttgctaataagaaggacgataaatgcatttctgggatgtatccattgcaatcttacggcgacgtgcatcctgattgccttcgtcataaccatgtatgtggtacttgtatctgagcctgcatccgtagacggaactatgggaaattttcttccgttttccaagatggatcttgcgacgaagagggacagacccttttattcgaattgtgtgaatactcaggactatttgttgaatccatcgtacatcaagcagaatgcctcgtttgtcatgctaacaaggaacggggagctagaagatgttatcaagactatcaacagtatagaagagcatttcaatcagtggttccactatccatatgtgttcttaaatgaccagccgtttgaagaggacttcaaagcaaaagtacgtgatgttacagtgggcgcgctggtggaatttggcactatcgatgagatatcttggaattttcccagtgacgtaaaggatacgttcgagttctacaacgcaattgaggatcaaggtgatagaagcatactttacggaaacttagaatcatatcataagatgtgccggttttattcaggattattttacaagcacccgctagtacagaagtacgaatggtattggagattggaacccgatgttgagtttttctgtgatattacctacgatccctttttggagatgctccgaactaataagaaatatggatttacgatcatcatccccgaattgtattggacagtcccaaatttgtttagacacactaaaagctttatcagtcaaaaaggcgttacgcttgggtcattatggaaactatttacaaaggattacgacatttttgaatccgatgatccggagttacgggactggatcaactatgattttcaggccaaggctaagatatccgaaaagatagccatcgagcagcttttgaaaaagggtgatgatttccaacagataaatgatgacaaagagggaataatgaatttgatacataaggctcgctctaggaagcatatcgtagaagacaaatttttcaatgaagagtacaatctatgccatttctggagtaattttgagattgcgcggctaagcgtgttcgacaatgacatttacaacagtttttttcaatatttggagaaaagtggtggattttggaaggaaagatggggggacgctcctgttcactctattggattgtcgctaactctggatttggacgatgtacactattttagagacatcggatatagacactccacaatacagcattgtccacataatgccatggggaatgaggaattctcctacttagccagtgactcaaaattcaaacgtaaaaacgcggcctacgacgagggaagggaatttgggtgtggctgcaggtgcagatgtcccaagaaaaagcgtgaaattgaggattccatgggtttctgcgtaaatatttgggtaaatctgcttaaccaacagaggggacacgaacgccacgtcgaagcactcaacggcaatgaaatggaggagcacataagggaagactatctaagacagttcggaaactag

SEQ ID NO: 170 - protein, 522 aa, Saccharomyces cerevisiae
MLLIRRTINAFLGCIHCNLTATCILIAFVITMYVVLVSEPASVDGTMGNFLPFSKMDLATKRDRPFYSNCVNTQDYLLNPSYIKQNASFVMLTRNGELEDVIKTINSIEEHFNQWFHYPYVFLNDQPFEEDFKAKVRDVTVGALVEFGTIDEISWNFPSDVKDTFEFYNAIEDQGDRSILYGNLESYHKMCRFYSGLFYKHPLVQKYEWYWRLEPDVEFFCDITYDPFLEMLRTNKKYGFTIIIPELYWTVPNLFRHTKSFISQKGVTLGSLWKLFTKDYDIFESDDPELRDWINYDFQAKAKISEKIAIEQLLKKGDDFQQINDDKEGIMNLIHKARSRKHIVEDKFFNEEYNLCHFWSNFEIARLSVFDNDIYNSFFQYLEKSGGFWKERWGDAPVHSIGLSLTLDLDDVHYFRDIGYRHSTIQHCPHNAMGNEEFSYLASDSKFKRKNAAYDEGREFGCGCRCRCPKKKREIEDSMGFCVNIWVNLLNQQRGHERHVEALNGNEMEEHIREDYLRQFGN

SEQ ID NO: 171 - DNA, 1506 bp, Saccharomyces cerevisiae
  CDS (1)..(1506)
atgcttttacaaggaatgcgtttatcgcaaaggttacataagagacatctatttgcttccaagattttaacgtggactacgaaccctgctcatatacgccacctacatgatataaggccgcctgcatcaaacttcaatacgcaagaatcggcccccataccggagtctccagcaaactcaccaactcgaccacagatggcacctaaacccaatttgaaaaaaaaaaatcgtagtttaatgtattctattattggggtttccatagtaggtttatatttttggtttaaaagtaactccaggaaacaaaaactacctctttcggcgcaaaaagtctggaaggaagccatatggcaagaaagtgataaaatggattttaattacaaagaagcgttaaggcggtatattgaggcgttggatgaatgcgatcgctctcatgtcgatttattgtcagatgattataccagaatagagctgaaaattgctgaaatgtatgaaaagctcaatatgcttgaagaagcccaaaatttgtaccaagaattattaagtcggtttttcgaagcgctgaatgttcctggcaaagttgatgagagtgaaagaggcgaggttttaagaaaagacttgagaatcttgattaaatcgttagaaatcaataaggacatagaaagtggcaagagaaaattgctacaacatttacttttagctcaagaggaaattttaagcaaatcgccagagttgaaggaattttttgaaaacagaaaaaagaagctctcgatggtaaaagacatcaatagagaccctaatgatgattttaaaacatttgttagtgaggaaaatattaagtttgatgagcaaggctatatgattttggatctggaaaagaatagcagcgcttgggaaccctttaaggaagaattttttactgcgagagatttatatacagcttattgtctgtcatcaaaagacatagctgcagctctaagttgcaagataactagtgtggaatggatggttatggcagacatgccaccaggacagatattgctatcacaggcaaatttggggtcattgttctatcttcaagcagaaaagctagaagctgacttaaatcaattagagcaaaagaaaagtaaagagtccaaccaagagttagatatgggaacatacataaaagccgttagattcgtacgcaaaaatcgtgacttatgtctggaaagagcacaaaaatgttacgacagcgttattgcgtttgccaaaagaaacagaaaaattaggtttcatgtgaaggatcaactggatccttcaattgcacagtcaattgctctatctacctatggaatgggggttttaagccttcatgaaggtgttttggctaaagctgaaaaactattcaaagattcgatcactatggccaaggagactgaatttaatgaactccttgcagaagctgaaaaggaactagaaaagacgacagtcttgaaagcggccaaaaaagagggtttaaactaa

SEQ ID NO: 172 - protein, 501 aa, Saccharomyces cerevisiae
MLLQGMRLSQRLHKRHLFASKILTWTTNPAHIRHLHDIRPPASNFNTQESAPIPESPANSPTRPQMAPKPNLKKKNRSLMYSIIGVSIVGLYFWFKSNSRKQKLPLSAQKVWKEAIWQESDKMDFNYKEALRRYIEALDECDRSHVDLLSDDYTRIELKIAEMYEKLNMLEEAQNLYQELLSRFFEALNVPGKVDESERGEVLRKDLRILIKSLEINKDIESGKRKLLQHLLLAQEEILSKSPELKEFFENRKKKLSMVKDINRDPNDDFKTFVSEENIKFDEQGYMILDLEKNSSAWEPFKEEFFTARDLYTAYCLSSKDIAAALSCKITSVEWMVMADMPPGQILLSQANLGSLFYLQAEKLEADLNQLEQKKSKESNQELDMGTYIKAVRFVRKNRDLCLERAQKCYDSVIAFAKRNRKIRFHVKDQLDPSIAQSIALSTYGMGVLSLHEGVLAKAEKLFKDSITMAKETEFNELLAEAEKELEKTTVLKAAKKEGLN

SEQ ID NO: 173 - DNA, 327 bp, Saccharomyces cerevisiae
  CDS (1)..(327)
atgtccattgagaatctgaaatcatttgatcctttcgccgacacaggagacgacgaaaccgccacttcaaactatattcatattcgtatccaacagagaaatggtagaaaaactttaactacggtgcaaggtgtcccagaggaatatgatttaaagagaattcttaaggtcctaaagaaggactttgcatgtaatggtaacattgtcaaggatccagaaatgggggagattattcagttgcagggtgaccaaagagcaaaggtttgcgaatttatgatctcccaactgggattgcaaaagaagaacattaaaattcatgggttttaa

SEQ ID NO: 174 - protein, 108 aa, Saccharomyces cerevisiae
MSIENLKSFDPFADTGDDETATSNYIHIRIQQRNGRKTLTTVQGVPEEYDLKRILKVLKKDFACNGNIVKDPEMGEIIQLQGDQRAKVCEFMISQLGLQKKNIKIHGF

SEQ ID NO: 175 - DNA, 669 bp, Saccharomyces cerevisiae
  CDS (1)..(669)
atgaccgtcgttatcggagtcttggcattacagggtgcgttcattgaacatgtgcgacacgtagaaaaatgcatcgtcgaaaacagggatttctatgaaaaaaaactatctgtgatgacagtgaaggataaaaatcaactagctcaatgtgatgcattgatcatacctgggggagagtcgactgcaatgtcccttattgcagaaagaacaggattttacgacgatctctacgcattcgtacacaacccaagcaaggtaacctggggtacttgtgcaggtatgatttatatttcacaacaattatctaacgaagaaaaactggtcaagacgctgaatttactaaaggttaaagtaaaaagaaatgcatttgggagacaagctcagtcttctacccggatttgcgacttttcaaactttattcctcactgcaatgattttcctgctacttttataagagccccagtaatagaagaggtgctggatcctgaacatgtgcaggtcctgtacaaattagatgggaaggataatggtggtcaagaactaattgttgccgctaagcaaaaaaacaatattcttgcgacatcatttcatccggaattggcagaaaacgatatacggtttcacgactggttcatcagagaatttgttcttaaaaactacagtaaataa

SEQ ID NO: 176 - protein, 222 aa, Saccharomyces cerevisiae
MTVVIGVLALQGAFIEHVRHVEKCIVENRDFYEKKLSVMTVKDKNQLAQCDALIIPGGESTAMSLIAERTGFYDDLYAFVHNPSKVTWGTCAGMIYISQQLSNEEKLVKTLNLLKVKVKRNAFGRQAQSSTRICDFSNFIPHCNDFPATFIRAPVIEEVLDPEHVQVLYKLDGKDNGGQELIVAAKQKNNILATSFHPELAENDIRFHDWFIREFVLKNYSK

SEQ ID NO: 177 - DNA, 675 bp, Saccharomyces cerevisiae
  CDS (1)..(675)
atgaagattttaacccaagacgaaattgaagctcatcgctcacatacgctaaaaggtggtattgaaggtgcccttgccggatttgcaatctctgctataattttcaaagtcctaccaagaaggtacccaaaattcaagccttcgactctaacatggtccataaaaaccgccctttggatcacccctcccacggtcttgactgctatatgtgcggaggaggcctcgaacaatttcgacgctacaatgtacggatccggttcctcctcggaagacgcactagatgagcacagaagatggaagagtttgagtacaaaggacaagtttgtcgaaggtctatctaataacaagtataagatcatcaccggtgcctgggccgcttcgctgtatgggtcgtgggtaatcgtgaacaaagaccccatcatgaccaaagctcagaagatcgtgcaggcaagaatgtacgctcaattcattaccgtcgggctgctgctggcctccgttggtttgagcatgtacgagaataagttacatcctaacaaacaaaaggtcaacgaaatgcgccgctgggaaaacgcactgagggtcgccgaagaggaagagagactcgagaaagagggaagaaggaccggctacgtttctaacgaagaaagaataaactccaagatcttcaagtcgtaa

SEQ ID NO: 178 - protein, 224 aa, Saccharomyces cerevisiae
MKILTQDEIEAHRSHTLKGGIEGALAGFAISAIIFKVLPRRYPKFKPSTLTWSIKTALWITPPTVLTAICAEEASNNFDATMYGSGSSSEDALDEHRRWKSLSTKDKFVEGLSNNKYKIITGAWAASLYGSWVIVNKDPIMTKAQKIVQARMYAQFITVGLLLASVGLSMYENKLHPNKQKVNEMRRWENALRVAEEEERLEKEGRRTGYVSNEERINSKIFKS

SEQ ID NO: 179 - DNA, 1461 bp, Saccharomyces cerevisiae
  CDS (1)..(1461)
atgtcgcatactttaaaatcgaaaacgctccaagagctggacattgaggagattaaggaaactaacccattgctcaaactagttcaagggcagaggattgttcaagttccggaactagtgcttgagtctggcgtggtcataaataatttccctattgcttataagacgtggggtacactgaatgaagctggtgataatgttctggtaatttgtcatgccttgactgggtccgcagatgttgctgactggtggggccctcttctgggtaacgacttagcattcgacccatcaaggttttttatcatatgtttaaactctatgggctctccatatgggtctttttcgccattaacgataaatgaggagacgggcgttagatatggacccgaattcccattatgtactgtgcgcgatgacgttagagctcacagaattgttctggattctctgggagtaaagtcaatagcctgtgttattggtggctctatgggggggatgctgagtttggaatgggctgccatgtatggtaaggaatatgtgaagaatatggttgctctggcgacatcagcaagacattctgcctggtgcatatcgtggtctgaggctcaaagacaatcgatttactcagatcccaactacttggacgggtactatccggtagaggagcaacctgtggccggactatcggctgcacgtatgtctgcattgttgacgtacaggacaagaaacagtttcgagaacaaattctccagaagatctccttcaatagcacaacaacaaaaagctcaaagggaggagacacgcaaaccatctactgtcagcgaacactccctacaaatccacaatgatgggtataaaacaaaagccagcactgccatcgctggcatttctgggcaaaaaggtcaaagcgtggtgtccaccgcatcttcttcggattcattgaattcttcaacatcgatgacttcggtaagttctgtaacgggtgaagtgaaggacataaagcctgcgcagacgtatttttctgcacaaagttacttgaggtaccagggcacaaagttcatcaataggttcgacgccaattgttacattgccatcacacgtaaactggatacgcacgatttggcaagagacagagtagatgacatcactgaggtcctttctaccatccaacaaccatccctgatcatcggtatccaatctgatggactgttcacatattcagaacaagaatttttggctgagcacataccgaagtcgcaattagaaaaaattgaatctcccgaaggccacgatgccttcctattggagtttaagctgataaacaaactgatagtacaatttttaaaaaccaactgcaaggccattaccgatgccgctccaagagcttggggaggtgacgttggtaacgatgaaacgaagacgtctgtctttggtgaggccgaagaagttaccaactggtag

SEQ ID NO: 180 - protein, 486 aa, Saccharomyces cerevisiae
MSHTLKSKTLQELDIEEIKETNPLLKLVQGQRIVQVPELVLESGVVINNFPIAYKTWGTLNEAGDNVLVICHALTGSADVADWWGPLLGNDLAFDPSRFFIICLNSMGSPYGSFSPLTINEETGVRYGPEFPLCTVRDDVRAHRIVLDSLGVKSIACVIGGSMGGMLSLEWAAMYGKEYVKNMVALATSARHSAWCISWSEAQRQSIYSDPNYLDGYYPVEEQPVAGLSAARMSALLTYRTRNSFENKFSRRSPSIAQQQKAQREETRKPSTVSEHSLQIHNDGYKTKASTAIAGISGQKGQSVVSTASSSDSLNSSTSMTSVSSVTGEVKDIKPAQTYFSAQSYLRYQGTKFINRFDANCYIAITRKLDTHDLARDRVDDITEVLSTIQQPSLIIGIQSDGLFTYSEQEFLAEHIPKSQLEKIESPEGHDAFLLEFKLINKLIVQFLKTNCKAITDAAPRAWGGDVGNDETKTSVFGEAEEVTNW

SEQ ID NO: 181 - DNA, 309 bp, Saccharomyces cerevisiae
  CDS (1)..(309)
atgtcttttagaaagaaaaaactcaaacctccagcgggtagtcaatttattataaacgactccataatgagctatattgaccgcacgaaaacactaataaggatgattggatgcaagaaccagtacataaaagcacgtatgaaagataagaccttcttctatacgaagcaattccgtacagccaaaaacaaatttttctttcatctgtaccattgggaggccactcatattaacgttgaccactatatatgtacatgtcatcccattttttggggctctataggtcagaaactcaggagatccgcctga

SEQ ID NO: 182 - protein, 102 aa, Saccharomyces cerevisiae
MSFRKKKLKPPAGSQFIINDSIMSYIDRTKTLIRMIGCKNQYIKARMKDKTFFYTKQFRTAKNKFFFHLYHWEATHINVDHYICTCHPIFWGSIGQKLRRSA

SEQ ID NO: 183 - DNA, 1605 bp, Saccharomyces cerevisiae
  CDS (1)..(1605)
atgagctctgacgaagaagatttcaacgacatctacggcgatgataagcctaccactactgaagaagtcaaaaaagaagaagaacaaaataaggctggcagtggtacctcgcaattagatcaactagccgcactacaagcattatcttctagcttgaacaaactaaataatccaaatagtaacaacagtagtagtaataatagtaaccaagacacatcttctagtaagcaagatggcactgcgaatgacaaggaaggttccaatgaagacactaagaatgaaaaaaaacaagaaagcgctacatcagcaaatgccaatgccaacgctagttctgcaggaccttctggcttaccttgggaacaacttcaacaaaccatgtcacaattccagcaaccatcttctcaatcaccacctcaacagcaagtaactcaaaccaaagaggaacgttcgaaagcggatttgtctaaagaaagttgcaagatgttcattggtggtctgaattgggacactacggaagataatcttcgcgaatattttggtaagtatggtaccgtcactgatttgaaaatcatgaaagaccctgcaacaggtagatctagagggttcggtttcttatcttttgaaaaaccttctagtgttgatgaagtggtaaagacacaacatatcctcgatggtaaagttatcgacccaaaaagagctatcccaagagacgagcaagataaaaccggtaaaatctttgttggtggtattggtcctgatgtgagaccaaaggaatttgaagaatttttttctcagtggggtacgattatcgatgcgcaactgatgttagataaggataccggtcaatcaagaggttttggttttgtgacgtatgactccgctgacgccgttgacagagtttgtcagaataaattcatcgatttcaaagatcgcaagatcgaaatcaagagagctgagccaagacatatgcaacaaaaatcatcaaacaatggtggtaacaatggtggaaacaacatgaatcgtcgtggcggtaacttcggtaaccaaggcgatttcaaccaaatgtatcaaaaccctatgatgggcggttacaacccaatgatgaatccgcaagcaatgacagattactatcaaaagatgcaagaatattaccaacaaatgcaaaagcaaactggtatggattatactcaaatgtaccaacaacaaatgcagcaaatggcaatgatgatgccagggtttgccatgccacctaatgcaatgactttaaaccaaccacagcaagattcaaatgccactcaaggttccccagcaccttctgattccgataataataaatccaatgacgtccaaactattggtaatacatcaaacactgactctggttcaccgccattgaatttacctaatggtccaaagggcccatcacaatacaatgatgaccacaatagcggttatggctacaaccgtgatcgcggtgatcgtgatcgtaacgatcgtgaccgcgattacaatcaccgtagtggtggaaaccatagaagaaacggccgtggtggtcgcggtggatacaatagacgtaataatggctaccatccatataataggtaa

SEQ ID NO: 184 - protein, 534 aa, Saccharomyces cerevisiae
MSSDEEDFNDIYGDDKPTTTEEVKKEEEQNKAGSGTSQLDQLAALQALSSSLNKLNNPNSNNSSSNNSNQDTSSSKQDGTANDKEGSNEDTKNEKKQESATSANANANASSAGPSGLPWEQLQQTMSQFQQPSSQSPPQQQVTQTKEERSKADLSKESCKMFIGGLNWDTTEDNLREYFGKYGTVTDLKIMKDPATGRSRGFGFLSFEKPSSVDEVVKTQHILDGKVIDPKRAIPRDEQDKTGKIFVGGIGPDVRPKEFEEFFSQWGTIIDAQLMLDKDTGQSRGFGFVTYDSADAVDRVCQNKFIDFKDRKIEIKRAEPRHMQQKSSNNGGNNGGNNMNRRGGNFGNQGDFNQMYQNPMMGGYNPMMNPQAMTDYYQKMQEYYQQMQKQTGMDYTQMYQQQMQQMAMMMPGFAMPPNAMTLNQPQQDSNATQGSPAPSDSDNNKSNDVQTIGNTSNTDSGSPPLNLPNGPKGPSQYNDDHNSGYGYNRDRGDRDRNDRDRDYNHRSGGNHRRNGRGGRGGYNRRNNGYHPYNR

SEQ ID NO: 185 - DNA, 321 bp, Saccharomyces cerevisiae
  CDS (1)..(321)
atgtccacccttttgaagtctgctaaatctatcgttccattgatggaccgtgtccttgtccaaagaatcaaggcacaagcaaagacagcatccgggttgtatttacctgaaaagaacgtggagaagttaaaccaagctgaagttgttgccgtaggcccgggctttactgatgctaatggtaataaggttgttcctcaagttaaagttggtgaccaagttttgattccacagtttggtggttctaccattaaattgggtaacgacgatgaagttattcttttcagggacgctgaaatcctggctaagattgccaaggactaa

SEQ ID NO: 186 - protein, 106 aa, Saccharomyces cerevisiae
MSTLLKSAKSIVPLMDRVLVQRIKAQAKTASGLYLPEKNVEKLNQAEVVAVGPGFTDANGNKVVPQVKVGDQVLIPQFGGSTIKLGNDDEVILFRDAEILAKIAKD

SEQ ID NO: 187 - DNA, 1149 bp, Saccharomyces cerevisiae
  CDS (1)..(1149)
atggcaagtaaccagcacataggagcttcaaacctaaatgagaatgaggctatattaaccaaccgcgttgctgagctggaaaggcgtatgtcgatgtttgagggtatatttcacgcgttaagtaaccgtctcgatcttcactttaaaaaatatgatgtagtggtaaactcccaacagcaacaaatcaacgaactgaccgcgtttttatcaacattgctgaatgaccaacaacgccacgctgaaattctcagtgaaaaattaagcggaacgttgcatggggtgtcagctacgtcaatatccttaagccaaactcttgacccacaaggcttcactgatggaactacggcaccaggagctcctaggaattatacttcagtgcctatgaataatgatcaaactgctcatccgcaaaatgaaggagctgttagtaatgaaacactttttgaggacattttgaatggaaattcacaagaaaatgataagagtcaacaacaaactaacagctcaaattctataagccaagaaaataatagcaccaacccttcagtggacactcggttcaacaagccgcaaaattataattccaatttagtcccatccttggaagagtattcagcaaatccacctaacaatgatggtggccaaagtcaaggactgtacataagcagcaactcttctcaatcacggcagtctcctaatctccagaaagtttctcctaaccatgaaaatgcggttgaatcaaatgcacaagagagcgtgccgacatttgaggaggaacagtatgagactaaaacaggattgaaacggaaacgaatagtctgcacaagacccttcgaatttatcaagtcaccacactctgtgatggaggtttggaaggagtatacagaaggtgttaacgggcagccttctataaggaaaatggaagctctttatcaaacggcatggaggcgagatccagcagtaaataaaagatattcgagaagaaaggttctttggaaagccattcaaactggccttaatcgtgggtattcattaaactatgttgttgaaatattagaaaactcaagatatgttaatgataaacagaaggttaaacaacctattggttggttatgccacagttctcatattccagagactttgaagtga

SEQ ID NO: 188 - protein, 382 aa, Saccharomyces cerevisiae
MASNQHIGASNLNENEAILTNRVAELERRMSMFEGIFHALSNRLDLHFKKYDVVVNSQQQQINELTAFLSTLLNDQQRHAEILSEKLSGTLHGVSATSISLSQTLDPQGFTDGTTAPGAPRNYTSVPMNNDQTAHPQNEGAVSNETLFEDILNGNSQENDKSQQQTNSSNSISQENNSTNPSVDTRFNKPQNYNSNLVPSLEEYSANPPNNDGGQSQGLYISSNSSQSRQSPNLQKVSPNHENAVESNAQESVPTFEEEQYETKTGLKRKRIVCTRPFEFIKSPHSVMEVWKEYTEGVNGQPSIRKMEALYQTAWRRDPAVNKRYSRRKVLWKAIQTGLNRGYSLNYVVEILENSRYVNDKQKVKQPIGWLCHSSHIPETLK

SEQ ID NO: 189 - DNA, 729 bp, Saccharomyces cerevisiae
  CDS (1)..(729)
atgataaaaaactatttgggacgaagatggctcaataatcctgcaattcaagcatatgtgaaacaaaatgctgctgtcgcccattctacggtgtttcaaggaaatctttatgaatatacggtgatgagggagttatctgagaaactacgaatgacaaagttgagaaaaaccggtggcgcccatgatggtggcgtagacataaagggaagctggccagtagatgatatttattggaaaatttcatcgttaatgcccaatttggaaatggctagtaacataaaaagaacgaactcgcaaaatggcttcgtattgaaacctttaaagtataggataatcgaccatacttttgaaccattgaaagtactagtccaatgtaaggctttcactaaatcaaaattatctcctagagaattccgtgagttagtaggaacattcacctcactagtatcacatagtcaacgcaacaaaacagtatgcattatgtgttcccctcatatgttaacaaaagataccttaaatcttatcaataacatcacgcttcctctgatatatttacgtgttgagatgctgaaagagaagactgacgggcactttgacttaatcaattcaggaaaactaattaattattacgagaattcatacgcctctacgttaatgcaagattgcaagatttctgaatggctgaagttgaagttgtacaaaaatagtgactttaattcggaaaaataa

SEQ ID NO: 190 - protein, 242 aa, Saccharomyces cerevisiae
MIKNYLGRRWLNNPAIQAYVKQNAAVAHSTVFQGNLYEYTVMRELSEKLRMTKLRKTGGAHDGGVDIKGSWPVDDIYWKISSLMPNLEMASNIKRTNSQNGFVLKPLKYRIIDHTFEPLKVLVQCKAFTKSKLSPREFRELVGTFTSLVSHSQRNKTVCIMCSPHMLTKDTLNLINNITLPLIYLRVEMLKEKTDGHFDLINSGKLINYYENSYASTLMQDCKISEWLKLKLYKNSDFNSEK

SEQ ID NO: 191 - DNA, 630 bp, Saccharomyces cerevisiae
  CDS (1)..(630)
atgatatcaccatcaaaaaagagaaccattttatcaagcaagaatataaaccaaaaaccacgagcagtggtaaaaggcaatgaacttcgttcaccatcaaagagaaggtcacaaatagacacagactatgcactaaggcgaagtccaataaagacaatccaaatttctaaagctgcacaatttatgctgtatgaggaaacggctgaagaaagaaacatagctgtccacagacataatgaaatatacaataataacaattctgtgagcaatgagaataatccttcccaagtaaaagaaaacctttcacccgctaaaatttgcccttatgaaagagcatttttaagggaaggaggaagaattgcattgaaggacttaagtgttgacgaattcaaaggttacatacaggatcctctcaccgatgagactataccactgacgttgccactgggtgataaaaaaatcagcctacccagttttataacgccgccaagaaattcgaagatatctattttcttcactagtaaacaccaaggacagaacccagagacaaagatatcccgttctaccgatgacgtcagtgaaaaaaaagtagtgagaaaactgtccttccacgtctatgaagatgagtaa

SEQ ID NO: 192 - protein, 209 aa, Saccharomyces cerevisiae
MISPSKKRTILSSKNINQKPRAVVKGNELRSPSKRRSQIDTDYALRRSPIKTIQISKAAQFMLYEETAEERNIAVHRHNEIYNNNNSVSNENNPSQVKENLSPAKICPYERAFLREGGRIALKDLSVDEFKGYIQDPLTDETIPLTLPLGDKKISLPSFITPPRNSKISIFFTSKHQGQNPETKISRSTDDVSEKKVVRKLSFHVYEDE

SEQ ID NO: 193 - DNA, 621 bp, Saccharomyces cerevisiae
  CDS (1)..(621)
atgatgccctacaacacccctccaaatatccaagaacctatgaacttcgcaagcagcaacccctttggtattattccagatgcgctcagtttccagaatttcaaatatgatcgtcttcagcagcagcaacagcagcagcaacagcagcaacaaaatcgcactgcgtcatcgttacagcagccgcaacagcaacaaccaataagcccgcctttgtttttagtaggggccggtaccagcgaaaactcaaaccttaacaagaatgccaacactagtactatccctcctttactctttagcagatcgtctcagcattatgttgtcccagatatagaccactcctccataatatacaagaacaacatctgcaaatctttcaaagatgacttatttttctgtccaagatctttactttctctcgaagaacaacaagcatgcgagaaaatggataggctgaccgctgaacaaatgtcattgtatcatcagaacacgcaatccagttctaatcctggttctatgtcttcttcacctccaaattctgcttcttctatattcaactctaggccgaagttcaatccttatacatctcaaagttttaatcctttggaaagtgttcaagaatga

SEQ ID NO: 194 - protein, 206 aa, Saccharomyces cerevisiae
MMPYNTPPNIQEPMNFASSNPFGIIPDALSFQNFKYDRLQQQQQQQQQQQQNRTASSLQQPQQQQPISPPLFLVGAGTSENSNLNKNANTSTIPPLLFSRSSQHYVVPDIDHSSIIYKNNICKSFKDDLFFCPRSLLSLEEQQACEKMDRLTAEQMSLYHQNTQSSSNPGSMSSSPPNSASSIFNSRPKFNPYTSQSFNPLESVQE

SEQ ID NO: 195 - DNA, 534 bp, Saccharomyces cerevisiae
  CDS (1)..(534)
atgaaactggcgcaagacatgaatgtagatgaaatatttctcaaacaagcggcagaagctatagcggtaatctcatcaagtcccactcatacggaccccataatacgagagctactccacagaattcgacaatccagcccattgagcgcagttataccagcaccagaaaatgttttaaaggctggggagccggaaaatatggctagaggtcttataaggattccagaaacacaaacaaaaagaacaggaggtaacaaccatagcaaggaaggcgcacagctctacagctgtgcgaaatgtcagttgaaattcagcagaagttctgatctgagaagacatgaaaaggtacactcactcgtgctgccgcatatttgctcaaactgtggcaaagggtttgccaggaaggatgctctaaaaagacattctaacacactgacctgtcaaagaaacagaaagaaactaagtgaaggttcagacgttgatgtagatgagctcatcaaggatgcgataaagaatggtaccggcctgttgtaa

SEQ ID NO: 196 - protein, 177 aa, Saccharomyces cerevisiae
MKLAQDMNVDEIFLKQAAEAIAVISSSPTHTDPIIRELLHRIRQSSPLSAVIPAPENVLKAGEPENMARGLIRIPETQTKRTGGNNHSKEGAQLYSCAKCQLKFSRSSDLRRHEKVHSLVLPHICSNCGKGFARKDALKRHSNTLTCQRNRKKLSEGSDVDVDELIKDAIKNGTGLL

SEQ ID NO: 197 - DNA, 1425 bp, Saccharomyces cerevisiae
  CDS (1)..(1425)
atggaggtaacttcaatgtttctcaatagaatgatgaagaccaggactggtctttatcgcttatattcaacccttaaagttccacatgtagaaatcaatggcataaaatacaagaccgacccacagactaccaatgttacagattcaataataaagcttaccgacagatcattacatttgaaagaatcacatccagtaggcattcttcgcgatctaattgaaaagaaattaaactcagtcgacaacacatttaagatctttaataatttcaagcccgtggtaaccacaatggaaaacttcgattctttagggtttcctaaggatcatcctggaagatcaaaatctgacacatattatataaatgagacgcacctactgagaacacatacttcagcccacgaattagagtgctttcaaaaaataagaaacgattcagataatattaaaagtggatttttaatatctgcagatgtgtacagaagagatgaaattgacaaaactcactatccggtattccaccaaatggaaggagccacaatttggaaacgaacgaaggctgatgtgggcgtaaaggagccaatgtatatcgagaaaatccgtgaagatatcagacaggtagagaaccttttaaataaagaaaatgtaaagattacggttgacgatgatactatacctttgaaagaaaataatcctaaacaagagtatatgtccgatctggaggttgatttgtgctctcaacatttgaagaggtccattgaactgatagtttctgaagtttttaacaaaaaaatatctagcatgatcaagaacaaagcgaataatacacccaaagagctaaaagtccgttggattaacgcttacttcccctggaccgcgccctcatgggaaatagaggtttggtggcagggcgaatggctcgaactctgcggatgcggattgattcgtcaagatgtgctactaagagccggatataaaccttctgaaacaattgggtgggcttttggcttgggtttggaccgcattgctatgcttctttttgaaattccagatattagactgctttggagtcgtgatgaaagattttcaagacaattctccaagggattaattacttccttcaaaccttattcaaaacacccgggatcatttagggatgttgcgttttggttaccagaagataaaccagatattcatcaagttcatgaaaatgatttgatggaaattatcagaaatatagctggcgatttggtagagagtgtcaagctagtcgatagctttacgcatccgaaaactgggagaaaatctatgtgctacaggatcaactatcaatcaatggacagaaatttgacaaacgccgaagttaacactttgcaagacatggtgtgttctaaattggtaaaagaatacagcgtagaactcagatag

SEQ ID NO: 198 - protein, 474 aa, Saccharomyces cerevisiae
MEVTSMFLNRMMKTRTGLYRLYSTLKVPHVEINGIKYKTDPQTTNVTDSIIKLTDRSLHLKESHPVGILRDLIEKKLNSVDNTFKIFNNFKPVVTTMENFDSLGFPKDHPGRSKSDTYYINETHLLRTHTSAHELECFQKIRNDSDNIKSGFLISADVYRRDEIDKTHYPVFHQMEGATIWKRTKADVGVKEPMYIEKIREDIRQVENLLNKENVKITVDDDTIPLKENNPKQEYMSDLEVDLCSQHLKRSIELIVSEVFNKKISSMIKNKANNTPKELKVRWINAYFPWTAPSWEIEVWWQGEWLELCGCGLIRQDVLLRAGYKPSETIGWAFGLGLDRIAMLLFEIPDIRLLWSRDERFSRQFSKGLITSFKPYSKHPGSFRDVAFWLPEDKPDIHQVHENDLMEIIRNIAGDLVESVKLVDSFTHPKTGRKSMCYRINYQSMDRNLTNAEVNTLQDMVCSKLVKEYSVELR

SEQ ID NO: 199 - DNA, 1062 bp, Saccharomyces cerevisiae
  CDS (1)..(1062)
atgactacaaataatgacttctattttgctctactacgcatatctattctccaattattgaaggcacaaggatttgacagggcaaggcccagtctggtggatgtcatgaccgatctctatgcaaaattcttgagtttgttagcatcagaggtcagttctatcgctcaggcaagatgtgatcaggacgatacaattgctttacaagatataactctggctctggaaaatctaggtattgttaagcctacgaacgttctggatgtctatgatgaaaactccgaattatcaagttcacgaggaatggaaaagttcaaggactggtgtatttatagtactcaattgaccgacgcgcgaataactgccttacccacagtagaattactacaaagtgaggaaaaagaatctgatcctttgtcagcaatacctgactatctcaatcaattactgcaaaacaagggtgcgaaacagaaattagaaacaaagaatagaaaaacagagttgatagaagatctaataaataataatggattagatgattggatcaaattagtcattgctagacaacgtataaacatgattgaaagagcttccaaaaaagaatctcaaaatgtaccggctttaccacatattgcaggctataaatcttccattctaagccgccatcaccacactaccataacaaacgaagataggatgccttcggcgatgaccccaagagatgaggatgccttaacagagatccaagaaaatccatttgtaactagcaaactgccgataatgagaaaagaaaataggttagaaaatataactctttcatttgaggatgaggagcttgaatcacttggcgaagtggaaggccctaaccaaaagtctcaagaaaataacaatgaggaaagttttaaagagaacaataaaagtttaacagagtctcctcatggtgatgaccgtgacatatcaatgtttcaattcgactcaaatgttgatactaaatgggcagagcaggaagatatggacagcacatttcaacgtcgaacctcactagattatgggggttacttttaa

SEQ ID NO: 200 - protein, 353 aa, Saccharomyces cerevisiae
MTTNNDFYFALLRISILQLLKAQGFDRARPSLVDVMTDLYAKFLSLLASEVSSIAQARCDQDDTIALQDITLALENLGIVKPTNVLDVYDENSELSSSRGMEKFKDWCIYSTQLTDARITALPTVELLQSEEKESDPLSAIPDYLNQLLQNKGAKQKLETKNRKTELIEDLINNNGLDDWIKLVIARQRINMIERASKKESQNVPALPHIAGYKSSILSRHHHTTITNEDRMPSAMTPRDEDALTEIQENPFVTSKLPIMRKENRLENITLSFEDEELESLGEVEGPNQKSQENNNEESFKENNKSLTESPHGDDRDISMFQFDSNVDTKWAEQEDMDSTFQRRTSLDYGGYF

SEQ ID NO: 201 - DNA, 1308 bp, Saccharomyces cerevisiae
  CDS (1)..(1308)
atgtctggttatttttcagggttttctctaaacaagatcaccgattcaattgccaccgctgctcacaagacccaagacactttgaacaatgcattagcaaatgcaaatgtaaacttaaatgaccctcaaacaagactatcaatcaaatcgcgaactagatttgttcaggaatcattgggtactgtatcagatataagtaaattaccaccacagtaccaattcttggagaaaaaaagtgattccttagagaaggtatgtaaaaggattctactggtgtccaaaacgttcgaagtagagggctacgactatccaccaaatttaacggagagtatttcggattggtggtctctcaataaagatggctggtttggctctaaaaaatccgaaagttccactaaaaaaaagggatctaaccatgacgatgcttttttgccaaggtcttttgctcaagccatctcaaaagccgctgttgactgcgaatgtgaatttcaaaatttagaacacaacgaaaaggcagaactaaagaagaaaaaggagtctatcaaaactgcacagacaacggaagctcagggtgccgaccataatgaagaagacgaggaagatgaagaagatgaagaagatgatgaagatttgtctaatttgatcaaagttttcgattcgtggtcgacatgctataaaaatatcgatgaagggaaggcagagatggattctatgatggtcaaggaattcaacaaaaaattagaaacattaataaaccaagacttcaagaaggtccatgacctgcgcaaaaaagtggaagaatcaagactcaaatttgatacaatgcgttatgaagtcaaagcaaaagaagcagagttagaggcgaaaaaagctgaagccacaggagaagcacatagcaaggatgttagcgcaaaggacattagcgcaaacactaccacctcttttgacgaaacgccttctaccgaggatgaaaagccaaaatcagagggtgccgaagaggaatcaaagaaagaagcgaatgagcctactgttgatgacgttgctgatagaaaagaagatttaaagagtaacaaagtaaatgatgagccaccgattgaagaatctgaggataataaattactggaaaaactggaggatgaatttgtctccaatactacagcagcagtggaaacaatggaagaaatcactgacagttctgaaattctgggcttgataaaactgttccagaatttccagttggtttactttagacaatgtgtccaagaagtggaggcaaaccttaaagttctaaatggtttggaaatttag

SEQ ID NO: 202 - protein, 435 aa, Saccharomyces cerevisiae
MSGYFSGFSLNKITDSIATAAHKTQDTLNNALANANVNLNDPQTRLSIKSRTRFVQESLGTVSDISKLPPQYQFLEKKSDSLEKVCKRILLVSKTFEVEGYDYPPNLTESISDWWSLNKDGWFGSKKSESSTKKKGSNHDDAFLPRSFAQAISKAAVDCECEFQNLEHNEKAELKKKKESIKTAQTTEAQGADHNEEDEEDEEDEEDDEDLSNLIKVFDSWSTCYKNIDEGKAEMDSMMVKEFNKKLETLINQDFKKVHDLRKKVEESRLKFDTMRYEVKAKEAELEAKKAEATGEAHSKDVSAKDISANTTTSFDETPSTEDEKPKSEGAEEESKKEANEPTVDDVADRKEDLKSNKVNDEPPIEESEDNKLLEKLEDEFVSNTTAAVETMEEITDSSEILGLIKLFQNFQLVYFRQCVQEVEANLKVLNGLEI

SEQ ID NO: 203 - DNA, 1839 bp, Saccharomyces cerevisiae
  CDS (1)..(1839)
atggctgaaatgaagaattcgacagctgctagttccagatggacgaagagtcgtctctcccatttctttccctcgtacactaatagcagtggtatgggggccgcctcaactgatcaatcttctacgcagggagaagaactgcaccataggaagcactgtgaagaagacaatgatggtcaaaaaccgaaaaagtctcccgtatccacctctacaatgcaaataaaatctagacaggatgaggacgaggatgacggtcgaattgtcattaaaccagttaacgatgaagatgatacatcagtgattataactttcaatcagtcaatatccccttttattattacattgacattcgttgcgtccatttctgggttcatgtttggttatgatactggttacatatcgagtgcgctaatttctatcaatagagatttagacaacaaagttttaacttatggagaaaaagaattaattacggccgccacatcattgggcgctttgattacaagtgtgggcgctggtactgctgctgatgtgtttggaagaagaccatgtttaatgttctccaatctgatgtttttgatcggagcaattttacaaattaccgcgcacaagttttggcaaatggcggccggtagactgattatgggtttcggtgtcggtattggttctttgatttctcctctttttattagtgaaattgctcctaagatgatcaggggtaggttaaccgttataaattccctatggctgacaggtggtcaattgattgcttacggttgtggtgcgggcctgaaccacgtcaaaaacggttggagaatcttagttggtttgtccttgatacctactgttttgcagttttcttttttctgttttttgccggatacaccaagatactacgtaatgaaaggcgatttaaagagagcaaaaatggttctcaaacgaagttacgtaaacactgaagatgaaataattgatcaaaaagttgaagaattatctagcttaaatcaatcgataccaggaaaaaatccaataacaaaattctggaatatggtcaaggaattgcacactgtgccttcaaatttcagagctttgattattggttgtggtctacaagccattcaacaattcacaggttggaattccttaatgtatttctccggtacaatatttgaaactgttggattcaaaaattcttctgccgtttctattattgtctcaggtactaattttgtgttcacattaatagcatttttctgtattgataaaatcggccgtaggtacattttactgattggactacctggtatgactgtggcgctggttatatgtgctatagcgttccatttcctaggtattaagtttaacggtgctgatgcagtagtggcatctgatggattttcatcttggggcattgtcattatcgtatttattattgtgtatgcagccttttatgccctcggtatcggcactgttccatggcaacaatcggaattatttccacaaaacgtcagaggtgtagggacatcctacgctactgccaccaattgggcaggttctttagtcattgcgtctacgttcttgactatgttacaaaatattacaccaacgggtacattttcattctttgccggtgtagcatgtttatcaaccattttttgttacttttgttatccagaactatcaggattggagttagaggaagttcaaacaattttaaaggacggattcaatatcaaagcctctaaagctctagctaaaaagaggaaacaacaggtggccgaaggtgctgcccatcataaactcaaattcgaacctacacaggaaattgtagaaagttag

SEQ ID NO: 204 - protein, 612 aa, Saccharomyces cerevisiae
MAEMKNSTAASSRWTKSRLSHFFPSYTNSSGMGAASTDQSSTQGEELHHRKHCEEDNDGQKPKKSPVSTSTMQIKSRQDEDEDDGRIVIKPVNDEDDTSVIITFNQSISPFIITLTFVASISGFMFGYDTGYISSALISINRDLDNKVLTYGEKELITAATSLGALITSVGAGTAADVFGRRPCLMFSNLMFLIGAILQITAHKFWQMAAGRLIMGFGVGIGSLISPLFISEIAPKMIRGRLTVINSLWLTGGQLIAYGCGAGLNHVKNGWRILVGLSLIPTVLQFSFFCFLPDTPRYYVMKGDLKRAKMVLKRSYVNTEDEIIDQKVEELSSLNQSIPGKNPITKFWNMVKELHTVPSNFRALIIGCGLQAIQQFTGWNSLMYFSGTIFETVGFKNSSAVSIIVSGTNFVFTLIAFFCIDKIGRRYILLIGLPGMTVALVICAIAFHFLGIKFNGADAVVASDGFSSWGIVIIVFIIVYAAFYALGIGTVPWQQSELFPQNVRGVGTSYATATNWAGSLVIASTFLTMLQNITPTGTFSFFAGVACLSTIFCYFCYPELSGLELEEVQTILKDGFNIKASKALAKKRKQQVAEGAAHHKLKFEPTQEIVES

SEQ ID NO: 205 - DNA, 624 bp, Saccharomyces cerevisiae
  CDS (1)..(624)
atgcgcgtttttactttgattgcgattttgtttagttcatctttgttaacacatgcattctcctctaattatgctcctgtaggcatatcattacctgcttttaccaaagaatgtctttactatgatttatcctctgataaagatgtccttgtggtcagttaccaagttttgacaggtgggaatttcgagatagacttcgatattaccgcccctgatggctctgttatcgtcactgaaagacaaaagaagcattctgattttctactgaagtcgtttggtataggtaagtacactttctgtttgagtaataactacggcacttccccaaagaaagttgaaatcaccctcgaaaaggaaaaggaaattgtttcttcccatgaaagcaaagaggacataatcgcaaacaacgccatcgaggaaattgataggaacctgaataagatcaccaaaacaatggattatttaagggctagagaatggagaaacatgtatactgtgagttctactgagtcaagattaacatggctctcattactaattatgggggtaatggttggtatcagtatagtgcaggcattaattattcagttcttttttaccagtcgccaaaaaaactacgtatag

SEQ ID NO: 206 - protein, 207 aa, Saccharomyces cerevisiae
MRVFTLIAILFSSSLLTHAFSSNYAPVGISLPAFTKECLYYDLSSDKDVLVVSYQVLTGGNFEIDFDITAPDGSVIVTERQKKHSDFLLKSFGIGKYTFCLSNNYGTSPKKVEITLEKEKEIVSSHESKEDIIANNAIEEIDRNLNKITKTMDYLRAREWRNMYTVSSTESRLTWLSLLIMGVMVGISIVQALIIQFFFTSRQKNYV

SEQ ID NO: 207 - DNA, 483 bp, Saccharomyces cerevisiae
  CDS (1)..(483)
atgggtaaatcacatggttacagatctcgtacacgttacatgttccaacgtgacttcagaaagcatggtgccgttcacatgtccacctacttgaagatctacaaggttggtgacattgtcgacatcaaagccaatggttctatccaaaagggtatgccacacaagttctaccaaggtaagaccggtgtcgtctacaacgttaccaagtcttctgttggtgttatcatcaacaagatggtcggtaacagatacttggaaaagagattgaacttgagagttgaacacatcaagcactctaaatgtagacaagaatttttggaaagagttaaggccaatgctgctaagcgtgctgaagccaaggcccaaggtgttgctgtccaattgaagagacaaccagctcaaccaagagaatcccgtattgtctctactgaaggtaacgttcctcaaactttagctccagttccatacgaaaccttcatttaa

SEQ ID NO: 208 - protein, 160 aa, Saccharomyces cerevisiae
MGKSHGYRSRTRYMFQRDFRKHGAVHMSTYLKIYKVGDIVDIKANGSIQKGMPHKFYQGKTGVVYNVTKSSVGVIINKMVGNRYLEKRLNLRVEHIKHSKCRQEFLERVKANAAKRAEAKAQGVAVQLKRQPAQPRESRIVSTEGNVPQTLAPVPYETFI

SEQ ID NO: 209 - DNA, 1737 bp, Saccharomyces cerevisiae
  CDS (1)..(1737)
atgtcaattcaggcttttgtcttttgcggtaaaggttccaatttggctcccttcacccagccagattttccattccaaacgcagaacaaagacagtacagctgccacgagcggtgacaaacttaatgagttggtcaatagcgccctcgattcaactgtcataaatgagttcatgcaacattcaacgcgcttgcccaaggctcttttgcccatcggtaatagacctatgattgaatacgtcttggattggtgtgatcaggcagatttcaaagaaatcagtgtggtcgcacccgttgacgaaatcgaattaattgaaagtggactgacttcgtttttgtccctaagaaagcaacaatttgaactaatatacaaggctttgtcaaattccaaccacagtcatcacttgcaagatcctaagaaaattaatttcatcccttcgaaggcaaattctacaggtgagtccttgcaaaaagagcttttgcctagaatcaatggcgattttgtaatcttgccctgtgattttgtcacagatatacctccacaagtcttggtcgatcaatttaggaatagggatgataataacctagcaatgactatctactataagaactctttagatagtagtatcgataaaaagcaacagcaaaagcaaaaacaacagcaatttttcactgtttattcagaaaacgaagactcagagaggcagccaatacttttggacgtttattctcaaagggacgtcacaaagacaaaatatctacagatcagatctcatttattatggaactatccaaatttaacagtatccactaagttactgaactcattcatctacttttgttcctttgaactttgccagttgttaaaattaggacctcaatcaatgtcaagacaagcttcattcaaagatccatttactggaaaccaacaacagcaaaaccctcctactactgatgatgatgaagatcgcaatcatgatgatgacgatgattacaaaccttcggctacatctatccagcctacctacttcaaaaaaaagaatgatctcatcttggacccaataaactgtaataaatcattgagtaaggtttttagagatttatctcgtcgttcgtggcaacattcgaaaccgagggaaccaataggtatttttattttaccaaacgaaaccttgttcatcagagccaataacttgaatgcttacatggacgctaatagatttgtactaaagataaaatcacaaacgatgttcacgaaaaatatacagattcaatctgccgctatcggtgctgatgccatagtagatcccaaatgccaaatctctgctcatagtaatgtcaagatgtctgttctcggtactcaggccaatattggttccagatgtcgtgttgcagggtctctcttatttcctggagtccatcttggtgacgaagtaatcctggaaaattgtattattggacctatggcaaaaatcggttcaaagtgtaaactcagcaattgttatatcgaaggccattatgttgtggagcctaaaaataactttaaaggtgaaacactggccaacgtttatttggatgaagatgaggaggacgagttaatatatgatgatagtgttattgctggagaaagtgaaatcgccgaagaaactgacagtgatgatagaagcgatgaagattctgatgatagtgaatataccgacgagtacgagtacgaagatgacggattatttgagcgttaa

SEQ ID NO: 210 - protein, 578 aa, Saccharomyces cerevisiae
MSIQAFVFCGKGSNLAPFTQPDFPFQTQNKDSTAATSGDKLNELVNSALDSTVINEFMQHSTRLPKALLPIGNRPMIEYVLDWCDQADFKEISVVAPVDEIELIESGLTSFLSLRKQQFELIYKALSNSNHSHHLQDPKKINFIPSKANSTGESLQKELLPRINGDFVILPCDFVTDIPPQVLVDQFRNRDDNNLAMTIYYKNSLDSSIDKKQQQKQKQQQFFTVYSENEDSERQPILLDVYSQRDVTKTKYLQIRSHLLWNYPNLTVSTKLLNSFIYFCSFELCQLLKLGPQSMSRQASFKDPFTGNQQQQNPPTTDDDEDRNHDDDDDYKPSATSIQPTYFKKKNDLILDPINCNKSLSKVFRDLSRRSWQHSKPREPIGIFILPNETLFIRANNLNAYMDANRFVLKIKSQTMFTKNIQIQSAAIGADAIVDPKCQISAHSNVKMSVLGTQANIGSRCRVAGSLLFPGVHLGDEVILENCIIGPMAKIGSKCKLSNCYIEGHYVVEPKNNFKGETLANVYLDEDEEDELIYDDSVIAGESEIAEETDSDDRSDEDSDDSEYTDEYEYEDDGLFER

SEQ ID NO: 211 - DNA, 1581 bp, Saccharomyces cerevisiae
  CDS (1)..(1581)
atgtccaccctttttctgattggaatacacgagattgagaaatctcaaacaattgtacagaatgaacactattttgatagagtgattgagcttcaagatttggattctctgatggtagcattgtataaggacagagtttcgccttttccaaacgtccataactttgaaacgggcgtatctatagttctttatgacccttcaaaatttcaattatctgtgcgacaattggatgttctattcaagcgatttttcccatctttcaatatttctgcgatagatcatacacgagaggaaaacctgcaacgtcttgaatgtgttgagcgtgaaaatagcatctgtcgtaatagaataacgagaattaaccactggatgtatcaccatcatgatgatactccagacggtattaacaaaaacagctatggtactgtaaatgggaattctgtccccactcaagcatgtgaagcaaacatttacactttattattgcatttgaatgattccaaggcacaacatttacgaaaggcatcagtgccaaggctaattcgcaacatcgagtttatgtcttttttgtcagatccaatagaaaaaatttctcaagagggatcacattattggaacattctatcaacttgggacttttgtgctttatcattaagcactcaagaattgatttggtgcgggttcacgcttatcaaaaagttatctaaggatgcaaaagtactcattgcagataataagttactgctactactatttactttagaatcatcctatcatcaagttaacaaatttcacaattttaggcatgccatcgatgtcatgcaagccacatggcgattgtgtacatatcttcttaaagataatcctgtacaaacattactgttgtgtatggctgccataggtcatgatgtcggtcatcctgggactaacaatcaactattgtgcaactgtgaatcagaggttgctcaaaatttcaaaaatgtctctatcttggagaattttcacagggaattatttcaacaattgctatcagagcattggcctcaattgctatctatctccaaaaaaaaatttgattttatttccgaggctattctggccacagatatggcattgcattctcagtatgaggatagattaatgcatgaaaacccaatgaaacaaatcactttgatatctctaattattaaagctgcagacatctctaatgtgacgagaaccttgtcaatatcagcacgttgggcatacctcattactctcgaatttaatgattgcgctcttttggaaacatttcataaagctcaccgcccagaacaagactgttttggcgattcatacaagaatgttgattctccgaaagaagatttggaatcaattcaaaatattttggtgaacgtaacagaccctgatgatattatcaaagaccatccgcatattccaaacggtcaaatatttttcattaatacgtttgctgaagtatttttcaacgcattaagtcaaaaattctcaggattaaaatttttaagcgataatgtcaaaatcaataaagaatactggatgaaacacaagaaaccacaatag

SEQ ID NO: 212 - protein, 526 aa, Saccharomyces cerevisiae
MSTLFLIGIHEIEKSQTIVQNEHYFDRVIELQDLDSLMVALYKDRVSPFPNVHNFETGVSIVLYDPSKFQLSVRQLDVLFKRFFPSFNISAIDHTREENLQRLECVERENSICRNRITRINHWMYHHHDDTPDGINKNSYGTVNGNSVPTQACEANIYTLLLHLNDSKAQHLRKASVPRLIRNIEFMSFLSDPIEKISQEGSHYWNILSTWDFCALSLSTQELIWCGFTLIKKLSKDAKVLIADNKLLLLLFTLESSYHQVNKFHNFRHAIDVMQATWRLCTYLLKDNPVQTLLLCMAAIGHDVGHPGTNNQLLCNCESEVAQNFKNVSILENFHRELFQQLLSEHWPQLLSISKKKFDFISEAILATDMALHSQYEDRLMHENPMKQITLISLIIKAADISNVTRTLSISARWAYLITLEFNDCALLETFHKAHRPEQDCFGDSYKNVDSPKEDLESIQNILVNVTDPDDIIKDHPHIPNGQIFFINTFAEVFFNALSQKFSGLKFLSDNVKINKEYWMKHKKPQ

SEQ ID NO: 213 - DNA, 2367 bp, Saccharomyces cerevisiae
  CDS (1)..(2367)
atggcaggtcattcacacaggtcatcattaaaaaacggacacaaatcttacaaatccaaacatgcttctaaaggtgctttgaaaagattatacaaggggaaagtggaaaaagaacccgtgggcactggcaaaccagacaaacaagtttcaaaattgcaacgtaaaaacaaggcaaaacaattaagggcccaaaggatcttggattccattgaaaacaggaaattattcgaaggaaaaaatggcgctgccaaaatcattactattgttccgttagtgaatgatttagacccattggacattctttacaagctattaaagtgtgcagatgatgaaggaatcatggtgcaggaagtagactcaaaacgtatatttaatgttcatataaagaagtttaaaagcaatcttaaaatcataattccagacatgaccaattttttgaacattttagattgcgctaaagtagcagactttgttgtgtttgggctcagtggtgtccaagaagtcgatgaagaatttggtgagcagatcatccgtgcgttagaactacaaggtattgcttcatatatcggtgtcataagcaacctctcagcagtccatgaaaaggagaaattccaattggatgtcaagcaatccttagaaagttatttcaagcactttttcccaagtgaagaacgtgtttataatttggaaaaaaactcagacgctttaaacgtcttgagaacattgtgccagaggctaccaagatcaatcaattggagagacaatagaggttacgtagtcgctgactttgttgatttcgttgaaacctctcccgattctggtgacctggtaattgaggggaccgtccgtggtattggcttcaacgccaatagactggtccatattcctgattttggtgacttccaactgaataagatagaaaaaatcagtgaatcttcgcagaaaaggaaaataataaaggaaaaagctacagatagtctgagcttagagctggatttacaaacagttttcgaaagtaatatgaatagagatactttggacgaatatgccccagaaggcacggaagattggtcagattatgacgaggattttgagtacgacggtttgacaaccgcgagatacgacgaccatggcttcttgccagggagggaacaaacatcaaaaaaggcggcagttcctaagggaacttctgactatcaagcgaagtggtacttggatgacgtcattgacgcaaatgaggaagaagaggcagaacagaccaatggaaaggatgagacaatgatggaaattgatgatgaaatgatggtggagcaagacaatgaagaggtagcaggcgacgaagaatatgacatagaggataatgaaggatttgaagagctttcacccgaagaagaagaacgtcaactgagggaatttagagatatggaaaaggaggacagagagttccccgatgagatcgaactagagcccagtgaatctgccatcgaacgtttgaaaaggtatagaggtttgaaaaacttatacaactgtgattggcaagttgatgaaaaggacccatcatcaccagcggaatggaaacgtctattaaggattggcaattacaaaaacactaaaaacagaatcataaaggaaaccaagaatgaagcacaggccattgcaggtgatcgtattaggatgttcatcaggtttcctaagtttctgcttgaaaagattcaagatcctaaacaactattatttgctgtctacggattactacttcatgaacacaaaaatgcggtagtcaacttctctctacaaagatgggaacaatatgacaaacctgtgccttctcaggagcctatcgtagtacaatacggtgttagaagatacactattcaacctctattttctcaaggctctaacagtcctaataatgttcacaagtatgaaaggtttctgcatccagatacagtatcagttgccacatgtattgctcccgtagatttcacccagtcacctgcaatttttttcaagccatcaccaacagatgccaaaaatattgaattgattggtcacggtacattcctgaatgcagaccattcaagaatattagcaaagagagccattttgaccggtcatccattcagattccacaaaactgtggttactgtacgttacatgtttttcagaccagaagatgtggaatggttcaagtctatcccactgttcaccaaatcaggtaggtcaggtttcattaaagaaagtttgggtacgcatggttatttcaaggctacatttgatggtaaattatctgcgcaggatgttgttgctatgtccttgtacaaacgtatgtggcccatgccttcgttaccttggaatggtatgtaa

SEQ ID NO: 214 - protein, 788 aa, Saccharomyces cerevisiae
MAGHSHRSSLKNGHKSYKSKHASKGALKRLYKGKVEKEPVGTGKPDKQVSKLQRKNKAKQLRAQRILDSIENRKLFEGKNGAAKIITIVPLVNDLDPLDILYKLLKCADDEGIMVQEVDSKRIFNVHIKKFKSNLKIIIPDMTNFLNILDCAKVADFVVFGLSGVQEVDEEFGEQIIRALELQGIASYIGVISNLSAVHEKEKFQLDVKQSLESYFKHFFPSEERVYNLEKNSDALNVLRTLCQRLPRSINWRDNRGYVVADFVDFVETSPDSGDLVIEGTVRGIGFNANRLVHIPDFGDFQLNKIEKISESSQKRKIIKEKATDSLSLELDLQTVFESNMNRDTLDEYAPEGTEDWSDYDEDFEYDGLTTARYDDHGFLPGREQTSKKAAVPKGTSDYQAKWYLDDVIDANEEEEAEQTNGKDETMMEIDDEMMVEQDNEEVAGDEEYDIEDNEGFEELSPEEEERQLREFRDMEKEDREFPDEIELEPSESAIERLKRYRGLKNLYNCDWQVDEKDPSSPAEWKRLLRIGNYKNTKNRIIKETKNEAQAIAGDRIRMFIRFPKFLLEKIQDPKQLLFAVYGLLLHEHKNAVVNFSLQRWEQYDKPVPSQEPIVVQYGVRRYTIQPLFSQGSNSPNNVHKYERFLHPDTVSVATCIAPVDFTQSPAIFFKPSPTDAKNIELIGHGTFLNADHSRILAKRAILTGHPFRFHKTVVTVRYMFFRPEDVEWFKSIPLFTKSGRSGFIKESLGTHGYFKATFDGKLSAQDVVAMSLYKRMWPMPSLPWNGM

SEQ ID NO: 215 - DNA, 1296 bp, Saccharomyces cerevisiae
  CDS (1)..(1296)
atggtagtacaaaatagcccagtttcgtctgttcacacagccaatttctctgaacgggggagcaataccagaacaatgacgtataaaaataagcttactgtttgcttcgatgacatcctaaaagttggagcagaaatgatgatgcaacaacagttaaaaaatgtacaactagattcttatctcgtcaatggtttcagtcaatctcagcaaaaattattgaaagagaaggttaaattatttcatggaattttagatgatttagagacttctctaagccagagttcttcatatttagaaactcttactgcactcggaaaagaaaaggagaaagaaagagaggaagctgaaaaaaagagggctgaacaagaaaatatgaggaaggttagagaacaagaagaattaaaaaagcgacaagaactcgaagaagcctcccaacagcagcaactccagcaaaattcaaaggaaaaaaatggccttggtttgaacttctccacaacagcacctgcgaacacaacggatgccaacggttccaaagagaattatcaagaacttggatctcttcaatcatccagtcaaacacaacttgagaacgcaaatgctgctaataacggtgccgcattttctcccttaaccactactcgaatccaaagccagcaggcccaaccctcggatgtaatgttcaacgatttaaactctatggatatttcgatgttttcaggccttgacagtactggttttgactccacagccttcaatgccacggtggacgaaaccaaaggctttgacgataatgactcaggtaacaactacaatgacataaatatttcttctattgaaaacaacataaataataatatcaatagcaccaagaacggcaaggataacaacaacgaaagcaacaaaaataacaacggcgatgaaaagaataagaacaacaacgaggacaacgagaacaacaacaacagcagtgagaagaacaacaataataataataataacaataacaacaatgacgataacggcaacaacaacaacaacaacagtgggaacgacaataacaataccaccaacaacgacagcaataacaagaacaattctatcactaccggaaatgataatgaaaatatagttaataatgatttaccaacgaccgttgtttccaatcctggagataaccctcctccagccgacaacggtgaagaatacttgacattaaatgatttcaacgaccttaatattgactggtcgaccactggagataatggcgaattagacctcagcggcttcaatatatag

SEQ ID NO: 216 - protein, 431 aa, Saccharomyces cerevisiae
MVVQNSPVSSVHTANFSERGSNTRTMTYKNKLTVCFDDILKVGAEMMMQQQLKNVQLDSYLVNGFSQSQQKLLKEKVKLFHGILDDLETSLSQSSSYLETLTALGKEKEKEREEAEKKRAEQENMRKVREQEELKKRQELEEASQQQQLQQNSKEKNGLGLNFSTTAPANTTDANGSKENYQELGSLQSSSQTQLENANAANNGAAFSPLTTTRIQSQQAQPSDVMFNDLNSMDISMFSGLDSTGFDSTAFNATVDETKGFDDNDSGNNYNDINISSIENNINNNINSTKNGKDNNNESNKNNNGDEKNKNNNEDNENNNNSSEKNNNNNNNNNNNNDDNGNNNNNNSGNDNNNTTNNDSNNKNNSITTGNDNENIVNNDLPTTVVSNPGDNPPPADNGEEYLTLNDFNDLNIDWSTTGDNGELDLSGFNI

SEQ ID NO: 217 - DNA, 1941 bp, Saccharomyces cerevisiae
  CDS (1)..(1941)
atgaaagaaagcaaaaaaatggctaaagataatttaactaatttgctctctcaattgaacattcaattgtctcaagacgagcattcgcaggtcgaacagacttgcgtgaaactattggattctggatgtgagaatccagcggatgtatttagacgttgcttagtagctgttatccaacaggacaagtatcaaaaggctttacattatttaaaaaaattcaaacatatagatgacaagtacggtcgcaaatttgcgctagaaaaattgtacattttctataaattgaatatgccagatgaattcaacacattgtacacagcaattatcacagatgatctcgatacggtactaaaaaaggatatcgagtcacttagaggtatcctacatgtgagagctcaatattgttataaaaatgggctgtaccaagaagcttttaaaatatatcaacatttagcaagtcacaatgagaaggatcaggatagtcaaattgaactctcttgtaacgaaagggttccgctatccgttgcgacagagttaatgaacagatcacccttagttactcctatggatgaatcttcctacgatttattattcaatgaatcattcatcatggcatccgtaggtaaatatgacaaggctatcgaactattagaaaaagcgcttcaaggagccacgaatgaaggctatcaaaacgatattaatactattaaattgcaattatcatttgttttgcaaatggtggggaaaactgcacaaagtaaagaaatcttaaagggcttattgcaggaactgaaagccgattctccattctctttaatttgtcaaaataacctaaatgcgtttgttgatttctctaaatacaatacaaacttcaatttactgttaagggaattaaacgtagaaaaactaaacacttttaatttacaaaccttcacccatgaacaatggtcaaacattcaacgcaatgtacttttcctgcgtttgttcaacaatgtcaaaattcactctcaagagtcccttttatcaagaacgttcgataaatactctaagttagttgacaatgttactttggaaagctacaagacgcaggccaagaaactttaccaccacactacaaaaaccattttaagtggaacagatggaagtacgattggaatattactactgactatccaattgctaataatagagaaggaatgggaaaatgctatcagaataggagaattatttttaaatgaaagctggaaatcgtcctttgaaaaattcaacgattcacaagccatcgtgtgttacattttatttgaattatacaagattaagggaagaaacaactccaaaagtgttctgcttaaaaaattaggctccgtgagagtccaattgagcggaaaaatccaagaaaacataccattttggaaacacgtcgggtttgaattattgtccatgggtaatgctaaagaatcgaaggctttactcagagagatttcaaactttagtaaaggcgatgcagatgtccttgttgacagagttgtttcgtcagattctttggatatagcacaaggtatagatctagtgagagatattgatattgataaattaattcaacttggtgtgaaacccttagaatcgtcagcaaagagaagtaaaaacaccgcagttagcaaagttcaaaagagaaaagttttagagctaaagaagaaaagaaagattaaacgcctcgaaaaatttttacaaggtcgcgacacctccaaattacctgatcctgaaaggtggctgccattaagagacaggtctacttataggccaaagaaaaaacaacaaggtgcaaaacaaactcaaggtggtgctatgaacaaaaaatcagaacaggcccttgacatatcaaagaaagggaagcccactgttaataaaaagcctaagaacaagaagaagggccgtaaatag

SEQ ID NO: 218 - protein, 646 aa, Saccharomyces cerevisiae
MKESKKMAKDNLTNLLSQLNIQLSQDEHSQVEQTCVKLLDSGCENPADVFRRCLVAVIQQDKYQKALHYLKKFKHIDDKYGRKFALEKLYIFYKLNMPDEFNTLYTAIITDDLDTVLKKDIESLRGILHVRAQYCYKNGLYQEAFKIYQHLASHNEKDQDSQIELSCNERVPLSVATELMNRSPLVTPMDESSYDLLFNESFIMASVGKYDKAIELLEKALQGATNEGYQNDINTIKLQLSFVLQMVGKTAQSKEILKGLLQELKADSPFSLICQNNLNAFVDFSKYNTNFNLLLRELNVEKLNTFNLQTFTHEQWSNIQRNVLFLRLFNNVKIHSQESLLSRTFDKYSKLVDNVTLESYKTQAKKLYHHTTKTILSGTDGSTIGILLLTIQLLIIEKEWENAIRIGELFLNESWKSSFEKFNDSQAIVCYILFELYKIKGRNNSKSVLLKKLGSVRVQLSGKIQENIPFWKHVGFELLSMGNAKESKALLREISNFSKGDADVLVDRVVSSDSLDIAQGIDLVRDIDIDKLIQLGVKPLESSAKRSKNTAVSKVQKRKVLELKKKRKIKRLEKFLQGRDTSKLPDPERWLPLRDRSTYRPKKKQQGAKQTQGGAMNKKSEQALDISKKGKPTVNKKPKNKKKGRK

SEQ ID NO: 219 - DNA, 543 bp, Saccharomyces cerevisiae
  CDS (1)..(543)
atgttcgcaactcgctcattctgcctaagctcttctttattccgtccggctgctcaactgttgcgccctgctggccgctctactttacgaaatgtttggagacgctctattgcaaccgaacatttgacccagacggaggctaattctcgtcttgcttcccagcgtgttcaccgtccaaattctcctcatttgactatctatgaacctcaattgacttggtatctatccagtttacatcgtatcactggttgtgttgtcgccggtactctttatgctttcgctatgggctacttggtggctcctctcgctggatactctttggatacagctaccatttctggtcttattcagcaagttcccacctggatcaaagttcctgctaagtttgttatttcttatcctttgactttccacatttttaacggtattcgtcacttgatctgggataccaccaaggagttaagtctaaagggtgtctatcgtaccggttatgctgttcttgccctttccgttttgacctctggctattttgcgatgatttag

SEQ ID NO: 220 - protein, 180 aa, Saccharomyces cerevisiae
MFATRSFCLSSSLFRPAAQLLRPAGRSTLRNVWRRSIATEHLTQTEANSRLASQRVHRPNSPHLTIYEPQLTWYLSSLHRITGCVVAGTLYAFAMGYLVAPLAGYSLDTATISGLIQQVPTWIKVPAKFVISYPLTFHIFNGIRHLIWDTTKELSLKGVYRTGYAVLALSVLTSGYFAMI

SEQ ID NO: 221 - DNA, 282 bp, Saccharomyces cerevisiae
  CDS (1)..(282)
atggtcaccccaagagaacctaagaagagaaccactagaaagaagaaggacccaaatgcccctaagagggctttgtccgcctacatgtttttcgctaacgaaaacagagatattgttcgttctgaaaatccagatatcacatttggacaagtcggcaagaagttgggtgagaagtggaaggctctaacgccagaggaaaagcagccttacgaggccaaggcccaggccgataagaagagatatgaatccgaaaaggagttatataacgccactttggcttag

SEQ ID NO: 222 - protein, 93 aa, Saccharomyces cerevisiae
MVTPREPKKRTTRKKKDPNAPKRALSAYMFFANENRDIVRSENPDITFGQVGKKLGEKWKALTPEEKQPYEAKAQADKKRYESEKELYNATLA

SEQ ID NO: 223 - DNA, 1110 bp, Saccharomyces cerevisiae
  CDS (1)..(1110)
atgaatcagagcgatagcagcttgatggatttaccactggagatacatttatcattactagagtacgtgcctaatgaacttcgtgctgtcaataaatacttctacgttttgcataaccacagctataaggagaagagtttggcgtggatagctgaggacaactatatatgggccgttgtcaaacattcattatgtttatatgtcaagagtttggacccacttcgacagcatgccagagaaatcattcaagaaacgaaggaaccaggttttaatgtgccactgtgcatgactaaatacatcgcagattcttggtatattgtatacaatgcgctgcaatatcctggaaagataattaatatgggatgggacaaatataccaaaagtcaagattcaaatggttctgattctaccagtaactttaatagtcggcccaaggaaagaactcttatgcagtcgttgacagctttacctgttaacttttggtccaggaggaaggacgagcctacaccggtaaacgtttggttttatgtaaaaaatgcgcacgttgccagatacataccgaaaattattacggaaataggcatatgcaactatgggccgaagcagatcgtggcaagtgcaggatatatcaacgaattgataacatctgaaggaatatactgtgttaacctaggccaccttcccaggctatacgatgagcaaatttttgaaggcactggaacgacacatcttcccctggaactgaaagctatcgacaggacagattcagatgtttgtatcaatggtgatttagttctactcggttatgactttattccatatcagatatcgaagccgtggttactctttagaatcgaacccgtaaatagcattgaagcaatcttcaactatagtgaatgttctttttcataccagtttgcatggagtttggcctgcttacaatctgaagagaaaatttcatttcctagagacacgataattgggcacggtttaccttacaagccatccaaattgataagaattttcgtctacaagcatccggaacaaaagcaagatcttggtcaagaaatagcattgcccaactggaataccccttatcttcgaagatga

SEQ ID NO: 224 - protein, 369 aa, Saccharomyces cerevisiae
MNQSDSSLMDLPLEIHLSLLEYVPNELRAVNKYFYVLHNHSYKEKSLAWIAEDNYIWAVVKHSLCLYVKSLDPLRQHAREIIQETKEPGFNVPLCMTKYIADSWYIVYNALQYPGKIINMGWDKYTKSQDSNGSDSTSNFNSRPKERTLMQSLTALPVNFWSRRKDEPTPVNVWFYVKNAHVARYIPKIITEIGICNYGPKQIVASAGYINELITSEGIYCVNLGHLPRLYDEQIFEGTGTTHLPLELKAIDRTDSDVCINGDLVLLGYDFIPYQISKPWLLFRIEPVNSIEAIFNYSECSFSYQFAWSLACLQSEEKISFPRDTIIGHGLPYKPSKLIRIFVYKHPEQKQDLGQEIALPNWNTPYLRR

SEQ ID NO: 225 - DNA, 333 bp, Saccharomyces cerevisiae
  CDS (1)..(333)
atgtcttcacaaataattgatcgtccaaaacatgaactctctagagcagaattagaggaactagaagaatttgaattcaaacatggtccaatgtccctgataaatgatgctatggtgacaagaacacctgtgataatctcattaagaaacaatcataaaataatagcgagagtgaaagctttcgacaggcattgtaatatggttttagaaaatgtgaaggagctttggacagagaagaagggcaaaaatgtaattaatcgggaaagattcataagtaaactattcttaagaggtgattcagttatcgttgtgttaaaaacccctgttgagtaa

SEQ ID NO: 226 - protein, 110 aa, Saccharomyces cerevisiae
MSSQIIDRPKHELSRAELEELEEFEFKHGPMSLINDAMVTRTPVIISLRNNHKIIARVKAFDRHCNMVLENVKELWTEKKGKNVINRERFISKLFLRGDSVIVVLKTPVE

SEQ ID NO: 227 - DNA, 2184 bp, Saccharomyces cerevisiae
  CDS (1)..(2184)
atgaatgattggcatgagttcaatgccgcgataaagtcaatatattgtaatgcagaaggtgactcaagcagtataattaatagattggttggcttggcaatgaaaagcgaagattccacttttattgaggccgttttagttttgaaagaaaatgtgtcgaaagtagataaacaattaagatttttatggcttacttcaactattaattcaaggttttatccccctatacctatctcagaagcctcaccggtttcttggaataaaaccgaatattgcgcacctggtactgaagaactacaaaggcgttatccagggagagccaagttacagaatgaagaagactattcaggcggaatagaacaatgccgagatgtgccagattgctcattagttgcttctctaattaatcttaggtctaagaacttgaatctccctctaattaaacaaatatcatcaactaaatatcacgtcaatttaagttttaacggaagcaacaaaaggctagtgacagtagatatttcgcagatcccaacctcagtggatggcaaacaactttctttaaagagtaacgatatttcggacaaaattggagagcttgcattactgcttgtttctaaaggaacatattccacggatggctcaaatattagtatagatacttaccgcttaagtggcttcttaccagagataacacaagtaaacagctatcctttcgaaaaattatggaagtttcacaaatctaatttatgtctgatgggcgctggcaccgggaatcgttccaatgacatgataaagcccctagttgagaaccatgattactctataattgatatcacatatgattctaggctagtaaaattgcgagatccgaggaactcggcactaaatgttgaaatcagctatgaacagtatttaaaaaatttcaaacaactttatcttaattggaaccaagaaaaattattcaaacgttctcaggtacttcattttcggtacgatacttcacgctacaataaattttctatcgttgcagataaacctttatttcacctggtaaacaattctaaagtgacagagacggtatggttattgctagaatcccatttgcaagatgaaggcagccaagaaaatcggtcagtttcctttttgaatgaggctcccgaatgcataatttgtccaattgaacctccagtagaatgcggtggcaatcacattggacttcagctggtaaagttgagattagatgctgagactgagaggttattgtattgttattcaacaacaaacaacaatttcagtattcactctttctcagttgtgaaggaaatatgttttcaaagattgaaagatacaaaaagtctttttgccaaagtccttttctcttttccttatgaaatagagggaaaagcctcatttgatacttgtaatttttttcaaaatccgacttttgagttggaagttcactctgaacaagattatcaagtacttatggacgccgcatgtatctcaactagctcacatgatttaattaacatccaagtatattactttaatgactatgaattgataaagccaataatgtttgataaccactatcagcccgggcagggccttaaacaagacgtgcccatcttaactaatgtcaaatatatgattgtatgctcaacttacggccctccagcctcaacggaatttgaattacttgcctcgatacggttatcctcttcatggaggttaatatctggaataactttacggagtgttaacttgatatacggtacttatccatatcattgtcgcaacaggttccattggaaggaaacttcagacaaacttaaaattcagatgactttgccaaccaaaaagtattctacgaacaaactttttatacgtgtagtacccgtggaatcatcagcacgattaaggatgcgatgtaatattttcgagcctgaatcagctctctgtgtttatgaatgtcaagagtataggacatgtccatctgggggcatcgttatacctgatctggaagtctctcgtactaacattgttgtattgatgatagaaagaagtgtacctatttccagttgtttacctacggaaggacaattggatgaattggagttgtttgttgggtccagtcaaaaaatcagaattgaaaaatactccgatgatgtgataccaaaataa

SEQ ID NO: 228 - protein, 727 aa, Saccharomyces cerevisiae
MNDWHEFNAAIKSIYCNAEGDSSSIINRLVGLAMKSEDSTFIEAVLVLKENVSKVDKQLRFLWLTSTINSRFYPPIPISEASPVSWNKTEYCAPGTEELQRRYPGRAKLQNEEDYSGGIEQCRDVPDCSLVASLINLRSKNLNLPLIKQISSTKYHVNLSFNGSNKRLVTVDISQIPTSVDGKQLSLKSNDISDKIGELALLLVSKGTYSTDGSNISIDTYRLSGFLPEITQVNSYPFEKLWKFHKSNLCLMGAGTGNRSNDMIKPLVENHDYSIIDITYDSRLVKLRDPRNSALNVEISYEQYLKNFKQLYLNWNQEKLFKRSQVLHFRYDTSRYNKFSIVADKPLFHLVNNSKVTETVWLLLESHLQDEGSQENRSVSFLNEAPECIICPIEPPVECGGNHIGLQLVKLRLDAETERLLYCYSTTNNNFSIHSFSVVKEICFQRLKDTKSLFAKVLFSFPYEIEGKASFDTCNFFQNPTFELEVHSEQDYQVLMDAACISTSSHDLINIQVYYFNDYELIKPIMFDNHYQPGQGLKQDVPILTNVKYMIVCSTYGPPASTEFELLASIRLSSSWRLISGITLRSVNLIYGTYPYHCRNRFHWKETSDKLKIQMTLPTKKYSTNKLFIRVVPVESSARLRMRCNIFEPESALCVYECQEYRTCPSGGIVIPDLEVSRTNIVVLMIERSVPISSCLPTEGQLDELELFVGSSQKIRIEKYSDDVIPK

SEQ ID NO: 229 - DNA, 2223 bp, Saccharomyces cerevisiae
  CDS (1)..(2223)
atggatagaggcaggtggtgtttcctcgtgtccgtatcaagcagaataatgaatctgcaagaactattagcgaaagtaccgctgttgttatcgtatccgaccattattctatccagtaatctgatcgtaccttcccataatgatctcatatcacgagcagcctctacatcagcagcagagtatgctgacgaaaagctaatatttttcagtacagatcatgccatcagactgatttttctgccaaccttcgtagcttcttcctttaacctatttgcgcactattttaacttcatcaattactctagccgaaggaagtattatgttttatttactgcaatttatttcctatccatattgactgcgattttccatccaattcagtcaacatgcatcactctattgattatcaagctcctgactaccgctgatgagtcttcgccaaaaattgccctcaatttcaagaccattttgaaaacatttgttccctttattactttaacattagttatattgcgttgggatccttcttttgatgccagctcaggagatgtgaacaaaatttctacgtctttggccgcatatgctctcttaatattaacgctaagatatgcatcaccgctgatattatcgacgttatcaagtagcataggtgttgtttccaaagacaccagcgtcgcacagcattcgataagtagaaataagagatttccgctaattctcgtgttaccgattttttcctttgttcttttgtatctaatgactatagttaacaagacttacaatatccagttattaatggtatttgtgttttttggatgtctgtccattttctttttatcgttaaaagatttgttcacagaggatggaaatcaaaagaagggaggccaggaggatgaatattgtcgtatgtttgacataaagtacatgatttcctatttatggctgacaaggttcaccattttattgacaggcataatggctattgtagtacattttttatcgtttaatgaaattacttcttccatcaaaactgatttgttaagtttacttttcgtcgtagtggcagaatatgtttccagtttctctaacaaacaacctgattcgcactcccataatcatgcacatcaccattcccatctaaccgattcattgcctctcgaaaatgaaagtatgttcaaacaaatggcattgaataaggacaccaggtccattttttcgtttttattgttgaataccgctttcatgtttgtacaacttttatattcctttcgttccaaatcattgggcttattatctgattcgttgcatatggccttagattgcacatctttgctcttaggtctaattgctggtgtattgaccaagaaaccagcaagtgataaattccctttcggtctaaattatcttggtaccttggcaggtttcaccaatggtgttctgttactcggcatagtgtgcggtatctttgtggaggcaattgagagaattttcaaccccattcatcttcatgcaacaaatgagttgttggttgttgctacgttaggcttattagtgaaccttgtaggtttgtttgccttcgaccatggtgcacatgatcatggtggtactgataatgaaaacatgaaggggatttttttacatatattggcagatacattaggttctgttggcgttgttatttcgacgttattaatcaagttaacacactggccaatttttgatccgatcgcctctttattaattggttccttgattttacttagcgctctgcccctgctaaaatctacttccgcaaatattttactaagactggatgacaagaagcataatctagtaaagagtgcgctaaaccagatttcaacgacgccaggaatcacaggttatacaactcctagattttggccgacagagtcaggcagttccgggcattcacatgcacacacgcattctcatgcagagaatcatagccatgagcatcatcatgatcagaaaaacggttcacaagaacacccgagcttggtgggctatattcatgtacagtatgtagacggcgagaattcgacaattatcaagaaaagagttgaaaaaatattcgaaaatgtgtcgattaaagcgtgggtacaagttgagcctcaaaattccacttgttggtgccgggctacttctatgaacacaatttcagctaacccgaattctttaccgctacagcctatagcaaattga

SEQ ID NO: 230 - protein, 740 aa, Saccharomyces cerevisiae
MDRGRWCFLVSVSSRIMNLQELLAKVPLLLSYPTIILSSNLIVPSHNDLISRAASTSAAEYADEKLIFFSTDHAIRLIFLPTFVASSFNLFAHYFNFINYSSRRKYYVLFTAIYFLSILTAIFHPIQSTCITLLIIKLLTTADESSPKIALNFKTILKTFVPFITLTLVILRWDPSFDASSGDVNKISTSLAAYALLILTLRYASPLILSTLSSSIGVVSKDTSVAQHSISRNKRFPLILVLPIFSFVLLYLMTIVNKTYNIQLLMVFVFFGCLSIFFLSLKDLFTEDGNQKKGGQEDEYCRMFDIKYMISYLWLTRFTILLTGIMAIVVHFLSFNEITSSIKTDLLSLLFVVVAEYVSSFSNKQPDSHSHNHAHHHSHLTDSLPLENESMFKQMALNKDTRSIFSFLLLNTAFMFVQLLYSFRSKSLGLLSDSLHMALDCTSLLLGLIAGVLTKKPASDKFPFGLNYLGTLAGFTNGVLLLGIVCGIFVEAIERIFNPIHLHATNELLVVATLGLLVNLVGLFAFDHGAHDHGGTDNENMKGIFLHILADTLGSVGVVISTLLIKLTHWPIFDPIASLLIGSLILLSALPLLKSTSANILLRLDDKKHNLVKSALNQISTTPGITGYTTPRFWPTESGSSGHSHAHTHSHAENHSHEHHHDQKNGSQEHPSLVGYIHVQYVDGENSTIIKKRVEKIFENVSIKAWVQVEPQNSTCWCRATSMNTISANPNSLPLQPIAN

SEQ ID NO: 231 - DNA, 591 bp, Saccharomyces cerevisiae
  CDS (1)..(591)
atgaaacagatagtcaaaagaagccatgccatcagaatagttgcagcattaggaatcataggcctgtggatgtttttctcgtctaatgaactatccatcgctacgccgggcctaatcaaggcgaagtctggtatagatgaagtgcaaggggcggctgctgagaagaacgacgctcggttgaaagagatcgagaagcaaaccattatgccattgatgggcgatgacaaggtgaagaaggaagtgggcagggcgtcgtggaagtacttccataccctgctggcccgttttccggacgagcctactcctgaagaaagagagaaactgcacacgtttattgggttgtatgcagaactctatccatgcggggaatgttcatatcactttgtaaagttgattgagaagtatcccgtacagacatctagcaggacggctgccgcaatgtggggatgccacattcacaacaaggtgaacgaatacctaaagaaagacatatatgactgtgctaccatcctggaggactacgattgtggatgtagtgacagcgacggtaaacgcgtgtctctcgagaaggaggctaaacagcacggttga

SEQ ID NO: 232 - protein, 196 aa, Saccharomyces cerevisiae
MKQIVKRSHAIRIVAALGIIGLWMFFSSNELSIATPGLIKAKSGIDEVQGAAAEKNDARLKEIEKQTIMPLMGDDKVKKEVGRASWKYFHTLLARFPDEPTPEEREKLHTFIGLYAELYPCGECSYHFVKLIEKYPVQTSSRTAAAMWGCHIHNKVNEYLKKDIYDCATILEDYDCGCSDSDGKRVSLEKEAKQHG

SEQ ID NO: 233 - DNA, 1986 bp, Saccharomyces cerevisiae
  CDS (1)..(1986)
atgggcacactgtttcgaagaaatgtccagaaccaaaagagtgattctgatgaaaacaataaagggggttctgttcataacaagcgagagagcagaaaccacattcatcatcaacagggattaggccataagagaagaaggggtattagtggcagtgcaaaaagaaatgagcgtggcaaagatttcgacaggaaaagagacgggaacggtagaaaacgttggagagattccagaagactgattttcattcttggtgcattcttaggtgtacttttgccgtttagctttggcgcttatcatgttcataatagcgatagcgacttgtttgacaactttgtaaattttgattcacttaaagtgtatttggatgattggaaagatgttctcccacaaggtataagttcgtttattgatgatattcaggctggtaactactccacatcttctttagatgatctcagtgaaaattttgccgttggtaaacaactcttacgtgattataatatcgaggccaaacatcctgttgtaatggttcctggtgtcatttctacgggaattgaaagctggggagttattggagacgatgagtgcgatagttctgcgcattttcgtaaacggctgtggggaagtttttacatgctgagaacaatggttatggataaagtttgttggttgaaacatgtaatgttagatcctgaaacaggtctggacccaccgaactttacgctacgtgcagcacagggcttcgaatcaactgattatttcatcgcagggtattggatttggaacaaagttttccaaaatctgggagtaattggctatgaacccaataaaatgacgagtgctgcgtatgattggaggcttgcatatttagatctagaaagacgcgataggtactttacgaagctaaaggaacaaatcgaactgtttcatcaattgagtggtgaaaaagtttgtttaattggacattctatgggttctcagattatcttttactttatgaaatgggtcgaggctgaaggccctctttacggtaatggtggtcgtggctgggttaacgaacacatagattcattcattaatgcagcagggacgcttctgggcgctccaaaggcagttccagctctaattagtggtgaaatgaaagataccattcaattaaatacgttagccatgtatggtttggaaaagttcttctcaagaattgagagagtaaaaatgttacaaacgtggggtggtataccatcaatgctaccaaagggagaagaggtcatttggggggatatgaagtcatcttcagaggatgcattgaataacaacactgacacatacggcaatttcattcgatttgaaaggaatacgagcgatgctttcaacaaaaatttgacaatgaaagacgccattaacatgacattatcgatatcacctgaatggctccaaagaagagtacatgagcagtactcgttcggctattccaagaatgaagaagagttaagaaaaaatgagctacaccacaagcactggtcgaatccaatggaagtaccacttccagaagctccccacatgaaaatctattgtatatacggggtgaacaacccaactgaaagggcatatgtatataaggaagaggatgactcctctgctctgaatttgaccatcgactacgaaagcaagcaacctgtattcctcaccgagggggacggaaccgttccgctcgtggcgcattcaatgtgtcacaaatgggcccagggtgcttcaccgtacaaccctgccggaattaacgttactattgtggaaatgaaacaccagccagatcgatttgatatacgtggtggagcaaaaagcgccgaacacgtagacatcctcggcagcgcggagttgaacgattacatcttgaaaattgcaagcggtaatggcgatctcgtcgagccacgccaattgtctaatttgagccagtgggtttctcagatgcccttcccaatgtaa

SEQ ID NO: 234 - protein, 661 aa, Saccharomyces cerevisiae
MGTLFRRNVQNQKSDSDENNKGGSVHNKRESRNHIHHQQGLGHKRRRGISGSAKRNERGKDFDRKRDGNGRKRWRDSRRLIFILGAFLGVLLPFSFGAYHVHNSDSDLFDNFVNFDSLKVYLDDWKDVLPQGISSFIDDIQAGNYSTSSLDDLSENFAVGKQLLRDYNIEAKHPVVMVPGVISTGIESWGVIGDDECDSSAHFRKRLWGSFYMLRTMVMDKVCWLKHVMLDPETGLDPPNFTLRAAQGFESTDYFIAGYWIWNKVFQNLGVIGYEPNKMTSAAYDWRLAYLDLERRDRYFTKLKEQIELFHQLSGEKVCLIGHSMGSQIIFYFMKWVEAEGPLYGNGGRGWVNEHIDSFINAAGTLLGAPKAVPALISGEMKDTIQLNTLAMYGLEKFFSRIERVKMLQTWGGIPSMLPKGEEVIWGDMKSSSEDALNNNTDTYGNFIRFERNTSDAFNKNLTMKDAINMTLSISPEWLQRRVHEQYSFGYSKNEEELRKNELHHKHWSNPMEVPLPEAPHMKIYCIYGVNNPTERAYVYKEEDDSSALNLTIDYESKQPVFLTEGDGTVPLVAHSMCHKWAQGASPYNPAGINVTIVEMKHQPDRFDIRGGAKSAEHVDILGSAELNDYILKIASGNGDLVEPRQLSNLSQWVSQMPFPM

SEQ ID NO: 235 - DNA, 1164 bp, Saccharomyces cerevisiae
  CDS (1)..(1164)
atggaacagaacaggttcaagaaagaaacgaaaacttgtagcgctagctggccgcgcgcaccgcagtcgacgctgtgtgcgacagatcgcctcgagctcacatacgatgtgtacactagcgcagagcggcaacgccgctctcgcactgccactaggcttaaccttgtgtttttgcacggcagcggcatgagtaaggtggtatgggagtactatttgccgcgtctggtagccgccgatgcggagggcaattatgccatcgacaaggttttgttgatcgaccaggttaaccacggtgattctgcggtacgcaaccgcggcagactcggcaccaatttcaactggatcgacggggcccgcgacgtgctcaagattgccacatgcgagttgggcagtattgacagccacccggcactaaacgtagtcatcggccactcgatgggcgggttccaggctcttgcgtgtgacgtcctgcagcccaatctgtttcatttgctcatcttgatcgagcctgtagtaatcacacggaaagccatcggcgccgggaggccagggcttccgcccgattctccgcagatcccagaaaatctttataactccctacgtttaaagacgtgcgaccatttcgctaacgagtccgaatatgtaaaatatatgaggaacggttccttttttaccaatgcgcacagccaaatcctgcaaaacatcatcgattttgagaggacaaaagcctctggagacgatgaagatggtggacccgttcgcacgaagatggagcaggctcaaaatctcctctgctacatgaacatgcagacttttgcgcctttcctgatcagcaatgtgaagtttgtgaggaagcggactatccacattgtgggcgcgcgctccaactggtgtcctccgcaaaatcagctgtttttgcagaaaactctacagaactaccatctcgatgtcattcccggcggctcccacttggtcaacgttgaggctccggacctggtgatcgagaggattaatcaccacatccacgagtttgtccttacctccccgctgcagtcctcacacattccgcaattgacccttgaagaaagagcggtgatgtttgaccgggctttcgactcgttcaagaatgaagctttggttaaaacgactaaacaaaaactgtaa

SEQ ID NO: 236 - protein, 387 aa, Saccharomyces cerevisiae
MEQNRFKKETKTCSASWPRAPQSTLCATDRLELTYDVYTSAERQRRSRTATRLNLVFLHGSGMSKVVWEYYLPRLVAADAEGNYAIDKVLLIDQVNHGDSAVRNRGRLGTNFNWIDGARDVLKIATCELGSIDSHPALNVVIGHSMGGFQALACDVLQPNLFHLLILIEPVVITRKAIGAGRPGLPPDSPQIPENLYNSLRLKTCDHFANESEYVKYMRNGSFFTNAHSQILQNIIDFERTKASGDDEDGGPVRTKMEQAQNLLCYMNMQTFAPFLISNVKFVRKRTIHIVGARSNWCPPQNQLFLQKTLQNYHLDVIPGGSHLVNVEAPDLVIERINHHIHEFVLTSPLQSSHIPQLTLEERAVMFDRAFDSFKNEALVKTTKQKL

SEQ ID NO: 237 - DNA, 1929 bp, Saccharomyces cerevisiae
  CDS (1)..(1929)
atgtcatctcagtttttcctgaaaacctctcaggatatagagctcttccaaagctacccaacttttgagcaatccaacacaaactccaaggatttccctgtcatttcctcggttttatcgccatgtggcagatttttggctttatctacgaaggagaacgtcaaagtttttacaggtccatgtttggataacgttctattaacaatgaagttgtccgacgtctatgacctacacttctctccagcaggtaactacttaagcacttgggagagagcgtctatacaagacccaaatcacaagaacgttaaagtttggtatttgaataaaccatttaagaaagattgcgtttcggaggatatagtccctgcttacgaatatcaagccaaatcccaaagcggttggtttttacaattctccaaattagacaattatgggctaagactttttaaacacgacttgaagattgttaaattaagctccgctaatgccgacaatttcgacttccaatctccgtttgctgtcttgtctgatgatgaaacgtcccaacatttcaccacctacctaatctctccagctgaacatccaacaatttgtactttcacaccagaaaagggtggtaaaccggctcaattaatcatatgggccctctctgaaggtaaaatcaccaagaaaattgcctccaaaactttctttaaagctgattcctgccaattgaaatggaatccattaggtaatgctattttatgtttagctattactgattttgattcctcaaacaaatcatattatggtgaaaacacactatacttactgtctttccaaggtgtcaacgggactttgggtggtaactctgtacgtgtttctttaaccactggacctgtccacgatttcacttggtcgccaacttcaaggcaattcggtgtcatcgctggttacatgccagcaaccatttccttttttgacttaagaggtaatgttgtccattcattacctcaacaagccaaaaataccatgcttttctctccctctggtcattacattcttatcgccgggtttggtaatttacagggctccgtggaaatcctagatcgtctcgacaaattcaagtgtgtgagtaaatttgacgctaccaacacttctgtctgcaaatggtcaccgggtggagaatttatcatgacagctaccacttcaccaagattgagagtggataacggcgttaaaatatggcatgtatcaggctctttagtatttgttaaagagttcaaggagcttttgaaggtagactggaggtcaccatgtaattacaaaactttggaaaacaaagacgaagcatttttcgagaaccatatcattaataactgggaaccgctacctgattcgaccacatcttcacttgatcctaaaatatccaataaatcagaattgcaaatacattctagcgttcaagagtacataagtcaacacccaagcagagaagcaagctccaatggaaacggatctaaggccaaagctggaggcgcttataaaccacctcacgcaagaagaacaggcggtggacgtattgtccccggagttcctcctggtgcagcaaagaagaccatcccagggctagttccgggcatgagtgccaacaaggacgccaacaccaagaacaggagaagaagagccaataaaaagtcaagtgaaacgtcacctgattctactccggccccatctgctcctgcctccacaaatgcccccacaaacaataaagaaacttctccagaggagaagaaaataagatctttactaaagaaattaagggctattgaaaccttgaaggaaagacaggccgtcggcgacaaactagaagatacgcaagttctaaaaattcaaactgaagaaaaagtgttgaaagatttggaaaagttgggttggaaggatgaataa

SEQ ID NO: 238 - protein, 642 aa, Saccharomyces cerevisiae
MSSQFFLKTSQDIELFQSYPTFEQSNTNSKDFPVISSVLSPCGRFLALSTKENVKVFTGPCLDNVLLTMKLSDVYDLHFSPAGNYLSTWERASIQDPNHKNVKVWYLNKPFKKDCVSEDIVPAYEYQAKSQSGWFLQFSKLDNYGLRLFKHDLKIVKLSSANADNFDFQSPFAVLSDDETSQHFTTYLISPAEHPTICTFTPEKGGKPAQLIIWALSEGKITKKIASKTFFKADSCQLKWNPLGNAILCLAITDFDSSNKSYYGENTLYLLSFQGVNGTLGGNSVRVSLTTGPVHDFTWSPTSRQFGVIAGYMPATISFFDLRGNVVHSLPQQAKNTMLFSPSGHYILIAGFGNLQGSVEILDRLDKFKCVSKFDATNTSVCKWSPGGEFIMTATTSPRLRVDNGVKIWHVSGSLVFVKEFKELLKVDWRSPCNYKTLENKDEAFFENHIINNWEPLPDSTTSSLDPKISNKSELQIHSSVQEYISQHPSREASSNGNGSKAKAGGAYKPPHARRTGGGRIVPGVPPGAAKKTIPGLVPGMSANKDANTKNRRRRANKKSSETSPDSTPAPSAPASTNAPTNNKETSPEEKKIRSLLKKLRAIETLKERQAVGDKLEDTQVLKIQTEEKVLKDLEKLGWKDE

SEQ ID NO: 239 - DNA, 450 bp, Saccharomyces cerevisiae
  CDS (1)..(450)
atgtcagccaccagagccaataaagatattttcacactattcgacaagaagggtcaaggcgccattgccaaggattccttgggagattacctgagggcaattggctacaaccccaccaaccagctcgtacaggacatcataaacgcggattcgagcttgagagacgcctctagcttgacgctggaccagattacaggcctaattgaagtcaacgaaaaggaattggatgcaactaccaaggcaaagacagaagacttcgtcaaggcattccaggtcttcgacaaggaaagtacaggcaaggtatccgttggtgacttaaggtacatgctaactggcttgggtgaaaagttaaccgacgctgaagtagacgagctgttgaagggtgttgaagtggacagcaacggagaaattgactacaagaagttcatcgaagatgttttgagacaatga

SEQ ID NO: 240 - protein, 149 aa, Saccharomyces cerevisiae
MSATRANKDIFTLFDKKGQGAIAKDSLGDYLRAIGYNPTNQLVQDIINADSSLRDASSLTLDQITGLIEVNEKELDATTKAKTEDFVKAFQVFDKESTGKVSVGDLRYMLTGLGEKLTDAEVDELLKGVEVDSNGEIDYKKFIEDVLRQ

SEQ ID NO: 241 - DNA, 1782 bp, Saccharomyces cerevisiae
  CDS (1)..(1782)
atgtattcaattgttaaagagattattgtagatccttacaaaagactaaaatggggttttattccagtaaagcggcaggtggaagacctgccagatgacttaaattcaacagaaattgtcactatctccaacagtatccagagtcatgaaacagctgaaaatttcatcacgactacaagtgaaaaagatcaactacattttgagactagtagctatagtgaacataaagacaatgtgaacgttactagaagttatgaatatagagatgaagccgataggccatggtggagatttttcgatgaacaagagtatcggatcaatgaaaaggaaagatctcacaataaatggtatagttggttcaaacagggtacctctttcaaagaaaaaaaattattaattaaattggatgtccttttagccttttattcttgtattgcttattgggtgaaatatctggatacggttaatataaacaacgcttacgtttcgggaatgaaggaagatttaggctttcaaggtaatgatttggtgcatactcaagtaatgtacacagttggtaatattatatttcaattgccatttttgatttacctgaacaagctcccattaaactatgttttaccaagcctcgacttatgttggtcgcttttaaccgttggtgctgcatatgtcaattctgtaccacacttgaaagcaattaggtttttcattggggcttttgaagcgccaagttatttggcataccaatatttgtttggttccttttacaaacatgatgaaatggtgcgtcgttctgctttttactatttgggccagtatatcggtattctatccgctggtgggatccagtcagccgtatattcatcgttaaatggtgtaaatggtttagagggatggagatggaactttattattgacgctattgtgtctgtcgtagtgggccttattggattttactccctgccaggtgacccatacaactgttattctattttcttaactgatgatgaaattaggttggcgaggaaaagattaaaagaaaaccaaacaggtaaaagtgattttgaaacaaaagtattcgatattaaactgtggaaaacaattttcagtgattggaaaatatacattttaactttatggaatattttctgttggaatgacagtaatgtttcatctggggcatacctactatggttgaaatctttgaaaagatactctattcctaagctcaatcagttatccatgattactccgggtttaggtatggtttatttgatgcttactggtattattgcagataaattacactctcgttggtttgcgattatttttactcaggttttcaatatcattggtaactccatattagccgcttgggacgtcgcagaaggagccaaatggtttgcatttatgctgcaatgttttggttgggctatggctcctgttttatactcttggcaaaacgatatttgtcgccgagatgctcaaactagagctattactttagttacaatgaatattatggctcaatcatctaccgcatggataagtgttttggtttggaaaacagaagaagctcccaggtatttaaaggggtttactttcactgcatgttctgctttttgtctctccatttggacttttgttgtactctacttctataaacgtgatgaaaggaacaatgccaagaagaacggtattgtgctttataactctaaacatggtgtggaaaagccaacgtcaaaagacgttgaaaccttatcagtatctgatgaaaaataa

SEQ ID NO: 242 - protein, 593 aa, Saccharomyces cerevisiae
MYSIVKEIIVDPYKRLKWGFIPVKRQVEDLPDDLNSTEIVTISNSIQSHETAENFITTTSEKDQLHFETSSYSEHKDNVNVTRSYEYRDEADRPWWRFFDEQEYRINEKERSHNKWYSWFKQGTSFKEKKLLIKLDVLLAFYSCIAYWVKYLDTVNINNAYVSGMKEDLGFQGNDLVHTQVMYTVGNIIFQLPFLIYLNKLPLNYVLPSLDLCWSLLTVGAAYVNSVPHLKAIRFFIGAFEAPSYLAYQYLFGSFYKHDEMVRRSAFYYLGQYIGILSAGGIQSAVYSSLNGVNGLEGWRWNFIIDAIVSVVVGLIGFYSLPGDPYNCYSIFLTDDEIRLARKRLKENQTGKSDFETKVFDIKLWKTIFSDWKIYILTLWNIFCWNDSNVSSGAYLLWLKSLKRYSIPKLNQLSMITPGLGMVYLMLTGIIADKLHSRWFAIIFTQVFNIIGNSILAAWDVAEGAKWFAFMLQCFGWAMAPVLYSWQNDICRRDAQTRAITLVTMNIMAQSSTAWISVLVWKTEEAPRYLKGFTFTACSAFCLSIWTFVVLYFYKRDERNNAKKNGIVLYNSKHGVEKPTSKDVETLSVSDEK

SEQ ID NO: 243 - DNA, 1041 bp, Saccharomyces cerevisiae
  CDS (1)..(1041)
atgaaggcgtcgcacatttgctcttatttgctaagcattgcacccctagtggtgtcccatggagtacatcataatcgagatcatggccacgaggcaaaccatgagtccaagcaaagtttcttgattttgaagcaagaatccattttttactctctagtttgctttctgcagaaccacctctttgtcctgggaccccgttacaatgcgattgtggctatcctaatcatacaacttatgccgtgtcttttcgtactgtttgttcctggactgcgcaagaacgatcgtgccagcttgacactgtccttactagtttccttttctctaggaacactcctgggtgatattttattacacgtgatacctgaaagtctcagcggcgtaactgatgtcacaatggttggaggagccatatttctggggtttataagcttcttgactctggataaaacgatgcgtattctgtcagggacgtccaacgatgacggcagcatacattctcattctcatagtcatactccacaacaaactgcagagaagaaagcgggctttaacatgtctgcgtatctgaatgtcatatccggcattgctcatcacatcacggatggcatagcgctggctacgtcattctatagttccacacaagttggcataatgaccagcatagctgtcactttccatgagatccctcatgagctaggtgacttcgccattctgctttccagtgggtttacgttcccacaagcgataagagcccaagcggtgacagctttcggcgccgtcgttggaacgtccattggctgctggatgaacgaaatcgggaacaacagccataaagcaacgtcttcatccgcgaacgcatctgaacttatgctgccgttcacggcgggcggcctcatatacatagccactactagcgttgtaccgcagatcttacatagctccgcacccgatagcaagcttcgagagtttaagaagtgggccttgcagctagtcttcatttttgtaggatttgccgttatggcgctcatggatgagcattga

SEQ ID NO: 244 - protein, 346 aa, Saccharomyces cerevisiae
MKASHICSYLLSIAPLVVSHGVHHNRDHGHEANHESKQSFLILKQESIFYSLVCFLQNHLFVLGPRYNAIVAILIIQLMPCLFVLFVPGLRKNDRASLTLSLLVSFSLGTLLGDILLHVIPESLSGVTDVTMVGGAIFLGFISFLTLDKTMRILSGTSNDDGSIHSHSHSHTPQQTAEKKAGFNMSAYLNVISGIAHHITDGIALATSFYSSTQVGIMTSIAVTFHEIPHELGDFAILLSSGFTFPQAIRAQAVTAFGAVVGTSIGCWMNEIGNNSHKATSSSANASELMLPFTAGGLIYIATTSVVPQILHSSAPDSKLREFKKWALQLVFIFVGFAVMALMDEH

SEQ ID NO: 245 - DNA, 429 bp, Saccharomyces cerevisiae
  CDS (1)..(429)
atggatatggtatcaccagtcttgaacctacaatcatctattttaggtgagctcgtaggcattattggaaaagtgttctttctcttaatagaagagattaaatacccgataatcacacccaaaattattgtggatgcccagatatcttcttggtcattgttttttttcgcttcaatctgtaatctctctgcaaaatttcgggagccaatagtgacaacatcgtcaataataagtttgatggaatcggaaaaagatcttaaaaatgtaaatgagtatttccaaataatggccaaaatgctctttatattggaaaataaaatagttgtttcgctcttcgtagtatttaacatttccgttcttatcattgtaaagtctgagccatattcatatggaaaagtgctttttaaacctagttcctccatattttag

SEQ ID NO: 246 - protein, 142 aa, Saccharomyces cerevisiae
MDMVSPVLNLQSSILGELVGIIGKVFFLLIEEIKYPIITPKIIVDAQISSWSLFFFASICNLSAKFREPIVTTSSIISLMESEKDLKNVNEYFQIMAKMLFILENKIVVSLFVVFNISVLIIVKSEPYSYGKVLFKPSSSIF

SEQ ID NO: 247 - DNA, 1167 bp, Escherichia coli
  CDS (1)..(1167)
gtgaaacatctgcatcgattctttagcagtgatgcctcgggaggcattattcttatcattgccgctatcctggcgatgattatggccaacagcggcgcaaccagtggatggtatcacgactttctggagacgccggttcagctccgggttggttcactcgaaatcaacaaaaacatgctgttatggataaatgacgcgctgatggcggtatttttcctgttagtcggtctggaagttaaacgtgaactgatgcaaggatcgctagccagcttacgccaggccgcatttccagttatcgccgctattggtgggatgattgtgccggcattactctatctggcttttaactatgccgatccgattacccgcgaagggtgggcgatcccggcggctactgacattgcttttgcacttggtgtactggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgcggtattgaatctgtgtggtgcacgccgcacgggcgtctatattcttgttggcgtggtgttgtggactgcggtgttgaaatcgggggttcacgcaactctggcgggggtaattgtcggcttctttattcctttgaaagagaagcatgggcgttctccagcgaagcgactggagcatgtgttgcacccgtgggtggcgtatctgattttgccgctgtttgcatttgctaatgctggcgtttcactgcaaggcgtcacgctggatggcttgacctccattctgccattggggatcatcgctggcttgctgattggcaaaccgctggggattagtctgttctgctggttggcgctgcgtttgaaactggcgcatctgcctgagggaacgacttatcagcaaattatggtggtggggatcctgtgcggtatcggttttactatgtctatctttattgccagcctggcctttggtagcgtagatccagaactgattaactgggcgaaactcggtatcctggtcggttctatctcttcggcggtaattggatacagctggttacgcgttcgtttgcgtccatcagtttga

SEQ ID NO: 248 - protein, 388 aa, Escherichia coli
VKHLHRFFSSDASGGIILIIAAILAMIMANSGATSGWYHDFLETPVQLRVGSLEINKNMLLWINDALMAVFFLLVGLEVKRELMQGSLASLRQAAFPVIAAIGGMIVPALLYLAFNYADPITREGWAIPAATDIAFALGVLALLGSRVPLALKIFLMALAIIDDLGAIIIIALFYTNDLSMASLGVAAVAIAVLAVLNLCGARRTGVYILVGVVLWTAVLKSGVHATLAGVIVGFFIPLKEKHGRSPAKRLEHVLHPWVAYLILPLFAFANAGVSLQGVTLDGLTSILPLGIIAGLLIGKPLGISLFCWLALRLKLAHLPEGTTYQQIMVVGILCGIGFTMSIFIASLAFGSVDPELINWAKLGILVGSISSAVIGYSWLRVRLRPSV

SEQ ID NO: 249 - DNA, 1011 bp, Escherichia coli
  CDS (1)..(1011)
atgagtgcgttaaataagaaaagttttcttacttacctgaaagagggcggtatttacgtcgttcttttagttttgctggcgattattattttccaggacccaacatttttaagtctgttgaacttaagtaatattctcacccagtcatcggtgcgtattattatcgcgctcggtgtggcagggttaattgtcacccaggggaccgatctttctgctggtcgtcaggtagggctggcggcagtggtggctgcgacattattgcagtccatggataacgccaacaaagtgttcccggaaatggcgacgatgccgattgcgctggttattctgattgtctgtgccattggtgcggtgatcggtttgatcaacggtctgattatcgcttatctcaacgtgacgccgttcattaccacgctcggcacgatgatcatcgtctatggcatcaactcgctctattacgactttgtcggggcgtcgccaatttctggttttgacagtggcttctctacctttgctcagggctttgtcgcgctggggagtttccgtctctcttacatcaccttctacgcgttgattgcggtggcgttcgtctgggtgttgtggaacaaaacccgcttcggtaagaacatttttgccattggcggtaacccggaagcggcaaaagtatctggtgtcaacgtcggcctgaacctgctgatgatctacgcgttgtctggcgtgttctatgcctttggcgggatgttagaagccggacgtatcggctctgccaccaacaacctcggctttatgtatgagctggatgctatcgcggcgtgcgtggtaggcggtgtatcgttcagcggcggtgtggggacggtgattggcgtggtgaccggggtaattatttttaccgtcatcaactatggcctgacgtatatcggcgtaaacccatactggcagtacatcatcaaaggggcgattattatcttcgccgtagcgctggattcactgaaatacgcgcgtaagaaatga

SEQ ID NO: 250 - protein, 336 aa, Escherichia coli
MSALNKKSFLTYLKEGGIYVVLLVLLAIIIFQDPTFLSLLNLSNILTQSSVRIIIALGVAGLIVTQGTDLSAGRQVGLAAVVAATLLQSMDNANKVFPEMATMPIALVILIVCAIGAVIGLINGLIIAYLNVTPFITTLGTMIIVYGINSLYYDFVGASPISGFDSGFSTFAQGFVALGSFRLSYITFYALIAVAFVWVLWNKTRFGKNIFAIGGNPEAAKVSGVNVGLNLLMIYALSGVFYAFGGMLEAGRIGSATNNLGFMYELDAIAACVVGGVSFSGGVGTVIGVVTGVIIFTVINYGLTYIGVNPYWQYIIKGAIIIFAVALDSLKYARKK

SEQ ID NO: 251 - DNA, 1290 bp, Escherichia coli
  CDS (1)..(1290)
atggaaacgactcaaaccagcacgattgcgtcgaaagactctcgtagtgcctggcgcaagacagacaccatgtggatgctgggcctttacggcacggcaatcggcgcgggcgtgctgttcctgccaatcaacgccggtgttggcggtatgatcccgctgatcatcatggctatccttgcgttcccgatgacgttttttgctcaccgcggcctgactcgcttcgtactgtctggtaaaaacccgggcgaagacatcaccgaggttgtagaagaacactttggtattggcgcaggtaaactgattaccctgctctacttcttcgctatctacccgatcctgctggtttatagcgtggcaatcaccaataccgttgaaagcttcatgtctcaccagctgggtatgacgccaccgccgcgtgcgattctgtcgctgatcctgatcgtgggtatgatgaccatcgttcgcttcggtgagcagatgatcgttaaagcgatgagtattctggtattcccgtttgttggcgtactgatgctgctggctctgtacctgatcccgcagtggaacggcgctgcactggaaacgctgtctctggacactgcatctgcaaccggaaacggtctgtggatgaccctgtggctggcaattccggtaatggtgttctcgttcaaccactctccgatcatctcttctttcgccgttgcgaagcgtgaagagtacggcgatatggcagaacagaaatgctcgaagatcctggcattcgcacacatcatgatggtgctgaccgtaatgttcttcgtcttcagctgtgtactgagcctgactccggcagacctggctgcggctaaagagcagaacatctcgattctgtcttacctggctaaccactttaacgcaccggttatcgcgtggatggctccgattatcgcgattatcgctatcaccaaatccttcctcggtcactacctgggcgcacgtgaaggcttcaacggtatggtgattaaatctctgcgtggtaaaggtaagtctatcgaaatcaacaagctgaaccgtatcactgcgctgttcatgctggtaacgacctggattgttgccaccctgaacccgagcatcctgggtatgattgaaaccctgggcggtccaatcatcgcgatgatcctgttcctgatgccgatgtacgcaattcagaaagtaccggcaatgcgtaagtacagcggtcacatcagcaacgtattcgttgtcgtgatgggtctgattgcaatctccgcaatcttctactctctgttcagctaa

SEQ ID NO: 252 - protein, 429 aa, Escherichia coli
METTQTSTIASKDSRSAWRKTDTMWMLGLYGTAIGAGVLFLPINAGVGGMIPLIIMAILAFPMTFFAHRGLTRFVLSGKNPGEDITEVVEEHFGIGAGKLITLLYFFAIYPILLVYSVAITNTVESFMSHQLGMTPPPRAILSLILIVGMMTIVRFGEQMIVKAMSILVFPFVGVLMLLALYLIPQWNGAALETLSLDTASATGNGLWMTLWLAIPVMVFSFNHSPIISSFAVAKREEYGDMAEQKCSKILAFAHIMMVLTVMFFVFSCVLSLTPADLAAAKEQNISILSYLANHFNAPVIAWMAPIIAIIAITKSFLGHYLGAREGFNGMVIKSLRGKGKSIEINKLNRITALFMLVTTWIVATLNPSILGMIETLGGPIIAMILFLMPMYAIQKVPAMRKYSGHISNVFVVVMGLIAISAIFYSLFS

SEQ ID NO: 253 - DNA, 219 bp, Escherichia coli
  CDS (1)..(219)
atgtttcattgtcctttatgccagcatgccgcacatgcgcgtacaagccgctatatcactgacacgacaaaagagcgttatcaccagtgtcagaacgtgaattgcagcgccacgttcatcacttatgagtcggtacagcgatacattgtgaagccgggagaagtccacgtcgtaaggccgcacccgttgccgtcagggcagcaaattatgtggatgtaa

SEQ ID NO: 254 - protein, 72 aa, Escherichia coli
MFHCPLCQHAAHARTSRYITDTTKERYHQCQNVNCSATFITYESVQRYIVKPGEVHVVRPHPLPSGQQIMWM

SEQ ID NO: 255 - DNA, 2391 bp, Escherichia coli
  CDS (1)..(2391)
atggcaattaacaatacaggctcgcgacgattactcgtcacgctaacagccctttttgcagcgctttgcgggctgtatctactcattggcggaggctggctggtcgcgattggcggctcctggtactaccctatcgctggccttgtgatgctcggcgtcgcctggatgctgtggcgcagtaaacgcgccgcgctttggctatacgcagccctgctgctcggcaccatgatttggggcgtctgggaagttggtttcgacttctgggcgctgactccgcgcagcgacattctggtcttcttcggcatctggctgatcctgccgtttgtctggcgtcgcctggtcattcctgccagcggcgcagttgccgcactggtggtcgcactgctgattagcggtggtatcctgacctgggccggatttaacgatccgcaggagatcaacggcaccttaagcgccgatgccacacctgctgaagctatctcccccgtagccgatcaggactggcctgcctatggtcgtaatcaggaaggtcaacgcttttcgccgctgaaacaaattaacgccgataacgtccataatctgaaagaagcctgggtgttccgtactggcgatgtgaagcagccgaacgatccgggtgaaatcaccaatgaagtgacgccgattaaagtgggcgacaccctttacctgtgtaccgctcaccagcgcctgtttgcgcttgatgccgccagcggcaaagagaaatggcattacgatcctgagctgaaaaccaacgagtctttccagcacgtaacctgccgtggtgtctcttatcatgaagccaaagcagaaaccgcttcgccggaagtgatggcggattgcccgcgtcgtatcattcttccggtcaatgatggtcgactgattgcgattaacgctgaaaacggcaaactgtgcgaaaccttcgccaataaaggcgtgctcaatctgcaaagcaatatgccagacaccaaaccgggtctgtatgaaccgacttcgccaccgattatcaccgataaaaccatcgtgatggccggttcagttaccgataacttctcaacccgcgaaacgtctggcgtgatccgtggttttgatgtcaacaccggggagctgctgtgggcttttgatcccggcgcgaaagatccgaacgcaatcccgtctgacgaacacacctttacctttaactcgccaaactcctgggcaccagcggcctatgacgcgaagctggatctggtctatctgccgatgggcgtgaccacgccggatatctggggcggtaaccgcacaccggaacaggaacgttatgccagctcgattctggcgctgaatgccactaccgggaaactggcgtggagctaccagaccgttcaccacgacctgtgggacatggatcttccggcacagccgacgctggcggacatcaccgttaatggtcagaaagtgccagttatttacgctccggcgaaaaccggcaacatttttgtgctcgatcgtcgtaatggcgaactggtggttccggcaccggaaaaaccggttccccaaggtgcagcgaaaggcgattacgtaaccccaactcaaccgttttctgaactgagcttccgtccgacgaaagatttgagcggtgcggatatgtggggagccaccatgtttgaccaactggtgtgccgcgtgatgttccaccagatgcgctatgaaggcattttcaccccgccatctgaacagggtacgctggtcttcccgggtaacctggggatgttcgaatggggcgggatttccgttgatccaaatcgtgaagtggcgattgccaacccaatggcactgccgtttgtttcgaaactgatcccgcgtggtcctggcaacccgatggagcagccgaaagatgccaaaggcacgggtacggaatccggcattcagccacagtacggtgtaccgtatggtgtcacgctcaacccgttcctctcaccatttggtctgccatgtaaacagccagcatggggttatatctcggcgctggatctgaaaactaatgaagtggtgtggaagaaacgtattggtacgccgcaggacagtatgccgttcccgatgccggttccggtgccgttcaatatgggtatgccgatgctgggcgggccaatctccacggcgggtaacgtgctgtttatcgccgctacggcagataactacctgcgcgcttacaacatgagcaacggtgaaaaactgtggcagggtcgtttaccagcgggtggtcaggctacgccaatgacctatgaagtgaatggtaagcagtatgtggtgatctccgcaggcggtcacggttcatttggtacgaagatgggcgactatattgtggcttatgcgctgccggatgatgtgaagtaa

SEQ ID NO: 256 - protein, 796 aa, Escherichia coli
MAINNTGSRRLLVTLTALFAALCGLYLLIGGGWLVAIGGSWYYPIAGLVMLGVAWMLWRSKRAALWLYAALLLGTMIWGVWEVGFDFWALTPRSDILVFFGIWLILPFVWRRLVIPASGAVAALVVALLISGGILTWAGFNDPQEINGTLSADATPAEAISPVADQDWPAYGRNQEGQRFSPLKQINADNVHNLKEAWVFRTGDVKQPNDPGEITNEVTPIKVGDTLYLCTAHQRLFALDAASGKEKWHYDPELKTNESFQHVTCRGVSYHEAKAETASPEVMADCPRRIILPVNDGRLIAINAENGKLCETFANKGVLNLQSNMPDTKPGLYEPTSPPIITDKTIVMAGSVTDNFSTRETSGVIRGFDVNTGELLWAFDPGAKDPNAIPSDEHTFTFNSPNSWAPAAYDAKLDLVYLPMGVTTPDIWGGNRTPEQERYASSILALNATTGKLAWSYQTVHHDLWDMDLPAQPTLADITVNGQKVPVIYAPAKTGNIFVLDRRNGELVVPAPEKPVPQGAAKGDYVTPTQPFSELSFRPTKDLSGADMWGATMFDQLVCRVMFHQMRYEGIFTPPSEQGTLVFPGNLGMFEWGGISVDPNREVAIANPMALPFVSKLIPRGPGNPMEQPKDAKGTGTESGIQPQYGVPYGVTLNPFLSPFGLPCKQPAWGYISALDLKTNEVVWKKRIGTPQDSMPFPMPVPVPFNMGMPMLGGPISTAGNVLFIAATADNYLRAYNMSNGEKLWQGRLPAGGQATPMTYEVNGKQYVVISAGGHGSFGTKMGDYIVAYALPDDVK

SEQ ID NO: 257 - DNA, 1332 bp, Escherichia coli
  CDS (1)..(1332)
atgagtacttcagatagcattgtatccagccagacaaaacaatcgtcctggcgtaaatcagataccacatggacgttaggcttgtttggtacggcaatcggcgccggggtgctgttcttccctatccgcgcaggttttggcggactgatcccgattcttctgatgttggtattggcataccccatcgcgttttattgccaccgggcgctggcgcgtctgtgtctttctggctctaacccttccggcaacattacggaaacggtggaagagcattttggtaaaactggcggcgtggttatcacgttcctgtacttcttcgcgatttgcccactgctgtggatttatggcgttactattaccaatacctttatgacgttctgggaaaaccagctcggctttgcaccgctgaatcgcggctttgtggcgctgttcctgttgctgctgatggctttcgtcatctggtttggtaaggatctgatggttaaagtgatgagctacctggtatggccgtttatcgccagcctggtgctgatttctttgtcgctgatcccttactggaactctgcagttatcgaccaggttgacctcggttcgctgtcgttaaccggtcatgacggtatcctgatcactgtctggctggggatttccatcatggttttctcctttaacttctcgccaatcgtctcttccttcgtggtttctaagcgtgaagagtatgagaaagacttcggtcgcgacttcaccgaacgtaaatgttcccaaatcatttctcgtgccagcatgctgatggttgcagtggtgatgttctttgcctttagctgcctgtttactctgtctccggccaacatggcggaagccaaagcgcagaatattccagtgctttcttatctggctaaccactttgcgtccatgaccggtaccaaaacaacgttcgcgattacactggaatatgcggcttccatcatcgcactcgtggctatcttcaaatctttcttcggtcactatctgggaacgctggaaggtctgaatggcctggtcctgaagtttggttataaaggcgacaaaactaaagtgtcgctgggtaaactgaacactatcagcatgatcttcatcatgggctccacctgggttgttgcctacgccaacccgaacatccttgacctgattgaagccatgggcgcaccgattatcgcatccctgctgtgcctgttgccgatgtatgccatccgtaaagcgccgtctctggcgaaataccgtggtcgtctggataacgtgtttgttaccgtgattggtctgctgaccatcctgaacatcgtatacaaactgttttaa

SEQ ID NO: 258 - protein, 443 aa, Escherichia coli
MSTSDSIVSSQTKQSSWRKSDTTWTLGLFGTAIGAGVLFFPIRAGFGGLIPILLMLVLAYPIAFYCHRALARLCLSGSNPSGNITETVEEHFGKTGGVVITFLYFFAICPLLWIYGVTITNTFMTFWENQLGFAPLNRGFVALFLLLLMAFVIWFGKDLMVKVMSYLVWPFIASLVLISLSLIPYWNSAVIDQVDLGSLSLTGHDGILITVWLGISIMVFSFNFSPIVSSFVVSKREEYEKDFGRDFTERKCSQIISRASMLMVAVVMFFAFSCLFTLSPANMAEAKAQNIPVLSYLANHFASMTGTKTTFAITLEYAASIIALVAIFKSFFGHYLGTLEGLNGLVLKFGYKGDKTKVSLGKLNTISMIFIMGSTWVVAYANPNILDLIEAMGAPIIASLLCLLPMYAIRKAPSLAKYRGRLDNVFVTVIGLLTILNIVYKLF

SEQ ID NO: 259 - DNA, 2049 bp, Escherichia coli
  CDS (1)..(2049)
atgaacatgttttttaggcttaccgcgttagctggcctgcttgcaatagcaggccagaccttcgctgtagaagatatcacgcgtgctgatcaaattccggtattaaaggaagagacgcagcatgcgacggtaagtgagcgcgtaacgtcgcgcttcacccgttctcattatcgccagttcgacctcgatcaggcattttcggccaaaatctttgaccgctacctgaatctgctcgattacagccacaacgtgctgctggcaagcgatgttgaacagttcgcgaaaaagaaaaccgagttaggcgatgaactgcgttcaggcaaactcgacgttttctacgatctctacaatctggcgcaaaagcgccgttttgagcgttaccagtacgctttgtcggtactggaaaagccgatggatttcaccggcaacgacacttataaccttgaccgcagcaaagcgccctggccgaaaaacgaggctgagttgaacgcgctgtgggacagtaaagtcaaattcgacgagttaagcctgaagctgacaggaaaaacggataaagaaattcgtgaaaccctgactcgccgctacaaatttgccattcgtcgtctggcgcaaaccaacagcgaagatgttttctcgctggcaatgacggcgtttgcgcgtgaaatcgacccgcataccaactatctttccccgcgtaataccgaacagttcaacactgaaatgagtttgtcgctggaaggtattggcgcagtgctgcaaatggatgatgactacaccgttatcaattcgatggtggcaggtggtccggcagcgaagagtaaagctatcagcgttggtgacaaaattgtcggtgttggtcaaacaggcaagccgatggttgacgtgattggctggcgtcttgatgatgtggttgccttaattaaagggccgaagggcagtaaagttcgtctggaaattttacctgctggtaaagggaccaagacccgtactgtaacgttgacccgtgaacgtattcgtctcgaagaccgcgcggttaaaatgtcggtgaagaccgtcggtaaagagaaagtcggcgtgctggatattccgggcttctatgtgggtttgacagacgatgtcaaagtgcaactgcagaaactggaaaaacagaatgtcagcagcgtcatcatcgacctgcgtagcaatggcggtggggcgttaactgaagccgtatcgctctccggtctgtttattcctgcgggtcccattgttcaggtccgcgataacaacggcaaggttcgtgaagatagcgataccgacggacaggttttctataaaggcccgctggtggtgctggttgaccgcttcagtgcttcggcttcagaaatctttgccgcggcaatgcaggattacggtcgtgcgctggttgtgggtgaaccgacgtttggtaaaggcaccgttcagcaataccgttcattgaaccgtatttacgatcagatgttacgtcctgaatggccagcgctgggttctgtgcagtacacgatccagaaattctatcgcgttaacggcggcagtacgcaacgtaaaggcgtaacgccagacatcatcatgccgacgggtaatgaagaaacggaaacgggtgagaaattcgaagataacgcgctgccgtgggatagcattgatgccgcgacttatgtgaaatcaggagatttaacggcctttgaaccggagctgctgaaggaacataatgcgcgtatcgcgaaagatcctgagttccagaacatcatgaaggatatcgcgcgcttcaacgctatgaaggacaagcgcaatatcgtttctctgaattacgctgtgcgtgagaaagagaataatgaagatgatgcgacgcgtctggcgcgtttgaacgaacgctttaaacgcgaaggtaaaccggagttgaagaaactggatgatctaccgaaagattaccaggagccggatccttatctggatgagacggtgaatatcgcactcgatctggcgaagcttgaaaaagccagacccgcggaacaacccgctcccgtcaagtaa

SEQ ID NO: 260 - protein, 682 aa, Escherichia coli
MNMFFRLTALAGLLAIAGQTFAVEDITRADQIPVLKEETQHATVSERVTSRFTRSHYRQFDLDQAFSAKIFDRYLNLLDYSHNVLLASDVEQFAKKKTELGDELRSGKLDVFYDLYNLAQKRRFERYQYALSVLEKPMDFTGNDTYNLDRSKAPWPKNEAELNALWDSKVKFDELSLKLTGKTDKEIRETLTRRYKFAIRRLAQTNSEDVFSLAMTAFAREIDPHTNYLSPRNTEQFNTEMSLSLEGIGAVLQMDDDYTVINSMVAGGPAAKSKAISVGDKIVGVGQTGKPMVDVIGWRLDDVVALIKGPKGSKVRLEILPAGKGTKTRTVTLTRERIRLEDRAVKMSVKTVGKEKVGVLDIPGFYVGLTDDVKVQLQKLEKQNVSSVIIDLRSNGGGALTEAVSLSGLFIPAGPIVQVRDNNGKVREDSDTDGQVFYKGPLVVLVDRFSASASEIFAAAMQDYGRALVVGEPTFGKGTVQQYRSLNRIYDQMLRPEWPALGSVQYTIQKFYRVNGGSTQRKGVTPDIIMPTGNEETETGEKFEDNALPWDSIDAATYVKSGDLTAFEPELLKEHNARIAKDPEFQNIMKDIARFNAMKDKRNIVSLNYAVREKENNEDDATRLARLNERFKREGKPELKKLDDLPKDYQEPDPYLDETVNIALDLAKLEKARPAEQPAPVK

SEQ ID NO: 261 - DNA, 1551 bp, Escherichia coli
  CDS (1)..(1551)
ttgttcatggcaacttatatgactttttcattaaagcaatcagggagagcaatgagtaaacacgacaccgacacttcagatcaacacgccgcgaaacgccgctggcttaatgcccacgaagaggggtatcacaaagcgatgggcaatcgccaggtgcagatgatcgccattggcggcgcgattggcaccggcttgtttttaggtgcaggagcccgactgcaaatggcggggcccgcactggcactggtttatttaatttgtggcttgttttcgttttttattctgcgtgcattgggtgagctggtgctacaccgcccttccagtggcagttttgtttcttatgcccgtgagtttttgggtgagaaagccgcttatgttgctggctggatgtacttcatcaactgggcgatgacggggattgttgatattaccgccgtcgctctgtatatgcattactggggtgcgtttggcggcgtgccgcagtgggtctttgcgctcgctgcacttaccatcgttggcaccatgaatatgatcggtgtgaaatggtttgcggagatggagttctggtttgcgcttattaaagtgctcgccattgtgacctttttggtcgtgggtacagtgttcctcggtagtggtcagccgctggatggcaacaccactggctttcatttaatcaccgataatggcggcttcttcccccacggtttgctgcctgcgctggtgttgattcagggcgtagtgtttgcttttgcctccattgaaatggtgggtacagctgccggagaatgtaaagatccgcagaccatggtgcctaaagccattaacagtgtgatttggcgtattggcctgttttacgtcggctccgtggtgttgctggttatgttattgccgtggagcgcgtatcaggcggggcaaagtccgttcgtgacgtttttctctaaactgggtgtgccatatatcggcagcattatgaacattgtggtgctgaccgctgccctctccagcctgaattcaggtctgtactgcaccggacgtattctgcgctcaatggcgatgggcggttccgcaccgagttttatggcgaaaatgagtcgtcagcatgtgccgtatgccgggattctggcgacactagttgtgtatgtcgtcggcgtattcctcaactatctggtgccgtcgcgcgtatttgagattgtgttgaacttcgcgtcgctgggaatcatcgcttcatgggcgtttatcatcgtgtgccagatgcgcctgcgtaaagcgattaaagaaggcaaagcagcggatgtcagttttaaactgcctggcgcgcccttcacttcctggctgacattactgtttttactgagtgtccttgtgctgatggcgttcgattacccgaacgggacttatactatcgcggcgctgccgattatcggtattttgctggttataggctggtttggtgtgcgcaaacgcgttgctgaaattcacagcactgcgccagtcgtcgaggaagatgaagaaaaacaggaaattgtgtttaagcctgaaacggcgagttaa

SEQ ID NO: 262 - protein, 516 aa, Escherichia coli
LFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETAS

SEQ ID NO: 263 - DNA, 681 bp, Escherichia coli
  CDS (1)..(681)
atgatcaggagtcacaccatgaccattacgtctctggatggctatcgctggctgaagaacgatattattcgcggtaattttcaaccggatgaaaaattacgaatgagtttgctgacatcgcgttatgcacttggcgttgggccgttacgggaagctctttcgcaactggtggcggaacggctggtcacggtggtgaatcaaaaagggtatcgggtggcgtctatgtcagagcaggagctgctcgatattttcgacgcccgcgccaatatggaagcgatgttagtgagtctggcgattgcccgcggtggcgatgagtgggaggcagacgttctcgcaaaagcgcatctgctgagtaagcttgaggcctgtgacgccagcgagaaaatgcttgatgagtgggatctgcgtcatcaggcgtttcatacggcaattgtggcgggctgtggttctcactatttgctgcaaatgcgtgaacggttgtttgatctggcggcgcgttatcgatttatctggctgcggcgaacggtgctttcggtggaaatgctggaggataaacacgatcagcaccagaccctgactgcggcggtactggcgcgagataccgcgcgcgccagtgagttaatgcgccagcatttactgacgccaattcccattatccagcaggcgatggctggcaattaa

SEQ ID NO: 264 - protein, 226 aa, Escherichia coli
MIRSHTMTITSLDGYRWLKNDIIRGNFQPDEKLRMSLLTSRYALGVGPLREALSQLVAERLVTVVNQKGYRVASMSEQELLDIFDARANMEAMLVSLAIARGGDEWEADVLAKAHLLSKLEACDASEKMLDEWDLRHQAFHTAIVAGCGSHYLLQMRERLFDLAARYRFIWLRRTVLSVEMLEDKHDQHQTLTAAVLARDTARASELMRQHLLTPIPIIQQAMAGN

SEQ ID NO: 265 - DNA, 1152 bp, Escherichia coli
  CDS (1)..(1152)
atgatggctaacagaatgattctgaacgaaacggcatggtttggtcggggtgctgttggggctttaaccgatgaggtgaaacgccgtggttatcagaaggcgctgatcgtcaccgataaaacgctggtgcaatgcggcgtggtggcgaaagtgaccgataagatggatgctgcagggctggcatgggcgatttacgacggcgtagtgcccaacccaacaattactgtcgtcaaagaagggctcggtgtattccagaatagcggcgcggattacctgatcgctattggtggtggttctccacaggatacttgtaaagcgattggcattatcagcaacaacccggagtttgccgatgtgcgtagcctggaagggctttccccgaccaataaacccagtgtaccgattctggcaattcctaccacagcaggtactgcggcagaagtgaccattaactacgtgatcactgacgaagagaaacggcgcaagtttgtttgcgttgatccgcatgatatcccgcaggtggcgtttattgacgctgacatgatggatggtatgcctccagcgctgaaagctgcgacgggtgtcgatgcgctcactcatgctattgaggggtatattacccgtggcgcgtgggcgctaaccgatgcactgcacattaaagcgattgaaatcattgctggggcgctgcgaggatcggttgctggtgataaggatgccggagaagaaatggcgctcgggcagtatgttgcgggtatgggcttctcgaatgttgggttagggttggtgcatggtatggcgcatccactgggcgcgttttataacactccacacggtgttgcgaacgccatcctgttaccgcatgtcatgcgttataacgctgactttaccggtgagaagtaccgcgatatcgcgcgcgttatgggcgtgaaagtggaaggtatgagcctggaagaggcgcgtaatgccgctgttgaagcggtgtttgctctcaaccgtgatgtcggtattccgccacatttgcgtgatgttggtgtacgcaaggaagacattccggcactggcgcaggcggcactggatgatgtttgtaccggtggcaacccgcgtgaagcaacgcttgaggatattgtagagctttaccataccgcctggtaa

SEQ ID NO: 266 - protein, 383 aa, Escherichia coli
MMANRMILNETAWFGRGAVGALTDEVKRRGYQKALIVTDKTLVQCGVVAKVTDKMDAAGLAWAIYDGVVPNPTITVVKEGLGVFQNSGADYLIAIGGGSPQDTCKAIGIISNNPEFADVRSLEGLSPTNKPSVPILAIPTTAGTAAEVTINYVITDEEKRRKFVCVDPHDIPQVAFIDADMMDGMPPALKAATGVDALTHAIEGYITRGAWALTDALHIKAIEIIAGALRGSVAGDKDAGEEMALGQYVAGMGFSNVGLGLVHGMAHPLGAFYNTPHGVANAILLPHVMRYNADFTGEKYRDIARVMGVKVEGMSLEEARNAAVEAVFALNRDVGIPPHLRDVGVRKEDIPALAQAALDDVCTGGNPREATLEDIVELYHTAW

SEQ ID NO: 267 - DNA, 1197 bp, Escherichia coli
  CDS (1)..(1197)
atgaattatcgctatcgcgccatgacccaggatggtcaaaaattgcaagggatcattgatgctaacgatgaacgtcaggcacgactgcggctgcgtgaagaagggcttttcctgctggatattcgcccccaaaaaagttcgggagtaaaaacacgtcgcccgaggatcagccatagtgaactgacgcttttcacccggcagttggcaaccttaagcgcagcggcattacccctggaagagagccttgccgtaatcggtcaacaaagcagtaataaacgactgggtgacgtgttaaatcaggtacgcagcgccatccttgaagggcatcccctttccgatgcattacagcattttcccacgcttttcgattcgctctatcgtaccctggtaaaagcgggcgaaaagagcgggctgctggccccggtgttggaaaagctggctgattacaatgaaaaccggcagaaaatccgcagcaagctcattcagtcactgatctacccctgtatgctcactacggtggcgattggggtcgtgattattctcctcactgctgtcgtgcccaaaattaccgaacagttcgtgcatatgaagcagcaactgccgctgagtacacgcattcttttaggtctgagcgacacgttgcaacgtaccggcccgacattattagcgacagtgtttattgtcgctgtaggtttctggctctggttaaaacgcggcaataaccgccaccgttttcatgccatgttgctgcgcgttgcgctcatcggcccgctgatttgcgccattaacagcgcacgctatctccgcactttaagtattttgcaatccagcggcgtccctctgctggatgggatgaatttgtccaccgaaagcctcaacaacctcgaaattcgccagcgtctggcaaatgcggcagagaacgttcgccagggtaacagcattcatctttcgctggaacaaaccgcaattttcccgccgatgatgctctacatggtggcctctggcgaaaaaagcgggcagctcggcacattaatggtcagagccgcagataaccaggagacactccaacaaaatcggatcgccttaacgctctccatcttcgagccagcactcattattacgatggcactgatcgtcctgtttattgtcgtgtcggtactccaacctcttcttcaacttaactcaatgattaattaa

SEQ ID NO: 268 - protein, 398 aa, Escherichia coli [sequence omitted]

SEQ ID NO: 269 - DNA, 660 bp, Escherichia coli
  CDS (1)..(660)
atggatcgtattgttagttcttcacatgaccgtacatcactgcttagcacccataaggtgctgcgtaatacctattttctgctgagcctgacgctggccttttcggcgattaccgcaactgccagtacggtgctgatgctgccatctccgggtctgattctgacgctggtgggtatgtatggtttgatgttcctgacctataaaacggcgaataagccgaccgggattatctccgcattcgcctttaccggttttctgggttatatcctcggacctattctgaacacctatctgtctgccggaatgggtgacgtaatcgctatggcactgggcggaacggcgttagtgttcttctgctgctctgcatatgtgctgaccacccgcaaagatatgtcgttcctcggcggtatgctgatggcgggtattgtggtggtgctgattggtatggttgcgaatatcttcctgcagctgcctgctctgcatctggcgatcagcgcggtcttcattctgatctcctctggcgctatcttgtttgaaaccagcaacatcattcatggcggtgagacgaactatattcgtgccacggttagcctgtatgtttcgctgtacaacatcttcgtcagcctgctgagcattctgggcttcgctagccgcgattaa

SEQ ID NO: 270 - protein, 219 aa, Escherichia coli
MDRIVSSSHDRTSLLSTHKVLRNTYFLLSLTLAFSAITATASTVLMLPSPGLILTLVGMYGLMFLTYKTANKPTGIISAFAFTGFLGYILGPILNTYLSAGMGDVIAMALGGTALVFFCCSAYVLTTRKDMSFLGGMLMAGIVVVLIGMVANIFLQLPALHLAISAVFILISSGAILFETSNIIHGGETNYIRATVSLYVSLYNIFVSLLSILGFASRD

SEQ ID NO: 271 - DNA, 1290 bp, Saccharomyces cerevisiae
  CDS (1)..(1290)
atgtccaacaagctgttcaggttagatgcaggctaccaacaatacgactggggtaaaatcggctcttcttcagctgtcgctcaatttgctgcccattctgacccctctgttcaaattgaacaagataaaccatatgcagagttatggatgggtacccacagcaagatgccttcctacaaccatgagtctaaggaatccctgagagatatcatctccaagaacccctctgccatgttaggtaaggacattattgataagttccacgccacaaatgaattgcccttccttttcaaagttttgtccattgaaaaagtcttgtctattcaagcacatcccgacaaagccttgggtaaaatattgcacgctcaagatcctaagaactatcctgatgataatcacaaacctgaaatggccatcgctgtgactgactttgaaggtttctgcgggttcaaacctttgcaagagattgcagatgaattgaaacgtattcctgaattacgcaacattgttggtgaagaaacttccaggaattttattgagaacattcaaccttctgctcagaaaggttccccagaagatgagcaaaacaaaaagctattgcaagctgttttcagcagggtcatgaacgcttcggatgacaaaatcaagattcaagctcgctccttggtcgaaagatcaaagaattctccatcagactttaacaaacctgatttaccagaattaattcaaagactgaataaacagttccctgatgacgtgggtttgttttgtggatgtttattgttgaatcactgcagattgaatgctggtgaagccatctttttaagagctaaggatcctcacgcctatataagcggtgatattatggaatgtatggctgcttctgacaacgtagttagagcaggcttcactccaaaattcaaggatgttaaaaacttggtctccatgttaacctatacatatgatcctgtggaaaagcaaaaaatgcagcctttaaagttcgacaggtcctctggtaacggtaagtcagttttatataaccctccaatcgaagaatttgctgtattggagactacttttgatgagaaacttggtcaaaggcattttgaaggtgttgatggtccaagtatcttaatcactacaaaaggtaatggttacattaaagcagatggccaaaaattgaaagctgaacccggttttgtctttttcatcgctccacatttgcctgttgatttggaagctgaagatgaggcgtttactacctatagagcctttgtggaaccaaattag

SEQ ID NO: 272 - protein, 429 aa, Saccharomyces cerevisiae
MSNKLFRLDAGYQQYDWGKIGSSSAVAQFAAHSDPSVQIEQDKPYAELWMGTHSKMPSYNHESKESLRDIISKNPSAMLGKDIIDKFHATNELPFLFKVLSIEKVLSIQAHPDKALGKILHAQDPKNYPDDNHKPEMAIAVTDFEGFCGFKPLQEIADELKRIPELRNIVGEETSRNFIENIQPSAQKGSPEDEQNKKLLQAVFSRVMNASDDKIKIQARSLVERSKNSPSDFNKPDLPELIQRLNKQFPDDVGLFCGCLLLNHCRLNAGEAIFLRAKDPHAYISGDIMECMAASDNVVRAGFTPKFKDVKNLVSMLTYTYDPVEKQKMQPLKFDRSSGNGKSVLYNPPIEEFAVLETTFDEKLGQRHFEGVDGPSILITTKGNGYIKADGQKLKAEPGFVFFIAPHLPVDLEAEDEAFTTYRAFVEPN

SEQ ID NO: 273 - DNA, 1539 bp, Saccharomyces cerevisiae
  CDS (1)..(1539)
atggtagcaacaataatgcagacgacaacaactgtgctgacgacagtcgccgcaatgtctactaccttagcatcaaattacatatcttcgcaagctagttcctcgacgagtgtaacaacagtaacgacaatagcgacatcaatacgctctacaccgtctaatctactcttttctaatgtggcggctcagccaaaatcatcttcagcaagcacaattgggctttcaatcggacttcccatcggaatattctgtttcggattacttatccttttgtgttatttctaccttaaaaggaattcggtgtccatttcaaatccacccatgtcagctacgattccaagggaagaggaatattgtcgccgcactaattggttctcacggttattttggcagagtaagtgtgaggatcagaattcatattctaatcgtgatattgagaagtataacgacacccagtggacctcgggtgataacatgtcttcaaaaatacagtacaaaatttccaaacccataataccgcagcatatactgacacctaagaaaacggtgaagaacccatatgcttggtctggtaaaaacatttcgttagaccccaaagtgaacgaaatggaggaagagaaagttgtggatgcattcctgtatactaaaccaccgaatattgtccatattgaatccagcatgccctcgtataatgatttaccttctcaaaaaacggtgtcctcaaagaaaactgcgttaaaaacgagtgagaaatggagttacgaatctccactatctcgatggttcttgaggggttctacatactttaaggattatggcttatcaaagacctctttaaagaccccaactggggctccacaactgaagcaaatgaaaatgctctcccggataagtaagggttacttcaatgagtcagatataatgcctgacgaacgatcgcccatcttggagtataataacacgcctctggatgcaaatgacagtgtgaataacttgggtaataccacgccagattcacaaatcacatcttatcgcaacaataacatcgatctaatcacggcaagaccccattcagtgatatacggtactactgcacaacaaactttggaaaccaacttcaatgatcatcatgactgcaataaaagcactgagaaacacgagttgataatacccaccccatcaaaaccactaaagaaaaggaaaaaaagaagacaaagtaaaatgtatcagcatttacaacatttgtcacgttctaaaccattgccgcttactccaaactccaaatataatggggaggctagcgtccaattagggaagacatatacagttattcaggattacgagcctagattgacagacgaaataagaatctcgctgggtgaaaaagttaaaattctggccactcataccgatggatggtgtctggtagaaaagtgtaatacacaaaagggttctattcacgtcagtgttgacgataaaagatacctcaatgaagatagaggcattgtgcctggtgactgtctccaagaatacgactga

SEQ ID NO: 274 - protein, 512 aa, Saccharomyces cerevisiae
MVATIMQTTTTVLTTVAAMSTTLASNYISSQASSSTSVTTVTTIATSIRSTPSNLLFSNVAAQPKSSSASTIGLSIGLPIGIFCFGLLILLCYFYLKRNSVSISNPPMSATIPREEEYCRRTNWFSRLFWQSKCEDQNSYSNRDIEKYNDTQWTSGDNMSSKIQYKISKPIIPQHILTPKKTVKNPYAWSGKNISLDPKVNEMEEEKVVDAFLYTKPPNIVHIESSMPSYNDLPSQKTVSSKKTALKTSEKWSYESPLSRWFLRGSTYFKDYGLSKTSLKTPTGAPQLKQMKMLSRISKGYFNESDIMPDERSPILEYNNTPLDANDSVNNLGNTTPDSQITSYRNNNIDLITARPHSVIYGTTAQQTLETNFNDHHDCNKSTEKHELIIPTPSKPLKKRKKRRQSKMYQHLQHLSRSKPLPLTPNSKYNGEASVQLGKTYTVIQDYEPRLTDEIRISLGEKVKILATHTDGWCLVEKCNTQKGSIHVSVDDKRYLNEDRGIVPGDCLQEYD

SEQ ID NO: 275 - DNA, 2901 bp, Saccharomyces cerevisiae
  CDS (1)..(2901)
atgaatccgggcggtgaacaaacaataatggaacaacccgctcaacagcaacaacaacagcaacaacaacagcagcaacagcaacagcaggcagcagttcctcagcagccactcgacccattaacacaatcaactgcggaaacttggctctccattgcttctttggcagaaacccttggtgatggcgacagggccgcaatggcatatgacgccactttacagttcaatccctcatctgcaaaggctttaacatctttggctcacttgtaccgttccagagacatgttccaaagagctgcagaattatatgaaagagcacttttggtaaatcccgaactatcagatgtgtgggctactttaggtcattgttatctgatgctggatgatctgcaaagagcttacaatgcctatcaacaggctctctaccacctcagtaatcccaacgtaccgaaattatggcatggaatcggcattctttatgacagatatggttcgctcgactatgccgaagaagcttttgccaaagttttggaattggaccctcattttgaaaaggcaaacgaaatttacttcagactaggtattatttataaacatcagggtaaatggtctcaagctttggaatgcttcagatacattctccctcaacctcctgctcccttgcaggagtgggacatatggtttcagttgggtagtgttttggagagtatgggagagtggcaaggtgcgaaggaagcctacgagcatgtcttggctcaaaatcaacatcatgccaaagtattacaacaattaggttgtctttacggtatgagtaacgtacaattttatgaccctcaaaaggcattggattatcttctaaagtcgttagaagcagatccctccgatgccactacatggtaccatctcggtagagtgcatatgattagaacagattatactgccgcatatgatgctttccaacaagctgttaatagagattcaagaaaccctatcttttggtgctcaatcggtgttttatattaccaaatttctcaatacagagacgccttagacgcgtacacaagagccataagattaaatccttatattagtgaagtttggtacgatctaggtactctttacgaaacttgtaacaaccaattatctgacgcccttgatgcgtataagcaagctgcaagactggacgtaaataatgttcacataagagaaagattagaagctttaacaaagcagttagaaaacccaggcaatataaacaaatcgaacggtgcgccaacgaatgcctctcctgccccacctcctgtgattttacaacctaccttacaacctaatgatcaaggaaatcctttgaacactagaatttcagcccaatctgccaatgctactgcttcaatggtacaacaacagcatcctgctcaacaaacgcctattaactcttctgcaacaatgtacagtaatggagcttcccctcaattacaagctcaagctcaagctcaagctcaagcacaagctcaagcacaagcacaagctcaagcacaagcacaagcacaagcgcaagcacaagcacaagcacaggcgcaagcacaggcacaagcacaagcacaagcacatgcacaagcgcaagcacaagcacaagcacaggcacaagcacaagcacaggcgcaggcacaacaacaacaacaacaacagcaacaacaacaacaacaacaacaacaacaacaacaacaacaacaacaacaacaacaacaacagcagcagcaattacagcccctaccaagacaacagctgcagcaaaagggagtttctgtgcaaatgttaaatcctcaacaagggcaaccatatatcacacagccaacagtcatacaagctcaccaactgcaaccattttctacacaagctatggaacatccgcaaagctctcaactgccacctcaacagcaacaactacaatctgttcaacatccacaacaacttcaaggccagcctcaagcccaagctccccaacctttaatccagcataacgtggaacagaacgttttacctcaaaagagatacatggaaggtgcaatccacactttagtagatgccgccgtatccagtagcacccacacagagaataacacaaagtctcctcgtcaaccaacccatgccattccaacgcaagctcccgcaacaggaataacgaacgctgaaccacaggtaaagaagcaaaagttgaactctccaaattcaaacatcaacaaattagtaaatactgctacttccattgaagaaaatgcaaaatctgaggtgagcaaccaatcgccagcagtagtggagtctaataccaataatacttcacaagaagaaaaacctgtaaaagcaaactcaataccttcagtaattggcgcacaggaacctccacaggaagctagtcctgctgaagaagctaccaaagcagcttctgtttctccttctacaaaaccgcttaatacggaaccagagtcatctagtgtccaaccaactgtatcatcagaaagttcaacaacaaaagcaaatgaccaaagcactgctgagaccatagaactttctactgctactgttcctgcagaagcaagccctgtagaagacgaagtaagacagcattctaaagaggaaaacggcacaactgaagcatctgcaccttctactgaagaggcggagccagcagcttccagagatgctgaaaaacaacaagatgaaaccgctgctacaacgataactgtaatcaaacctactttggaaacaatggaaacagtgaaagaggaggccaaaatgcgtgaggaagagcaaacatctcaagaaaaatccccacaggagaacacacttccaagagaaaatgtagtaaggcaagtggaagaagatgaaaactacgacgactaa

SEQ ID NO: 276 - protein, 966 aa, Saccharomyces cerevisiae
MNPGGEQTIMEQPAQQQQQQQQQQQQQQQQAAVPQQPLDPLTQSTAETWLSIASLAETLGDGDRAAMAYDATLQFNPSSAKALTSLAHLYRSRDMFQRAAELYERALLVNPELSDVWATLGHCYLMLDDLQRAYNAYQQALYHLSNPNVPKLWHGIGILYDRYGSLDYAEEAFAKVLELDPHFEKANEIYFRLGIIYKHQGKWSQALECFRYILPQPPAPLQEWDIWFQLGSVLESMGEWQGAKEAYEHVLAQNQHHAKVLQQLGCLYGMSNVQFYDPQKALDYLLKSLEADPSDATTWYHLGRVHMIRTDYTAAYDAFQQAVNRDSRNPIFWCSIGVLYYQISQYRDALDAYTRAIRLNPYISEVWYDLGTLYETCNNQLSDALDAYKQAARLDVNNVHIRERLEALTKQLENPGNINKSNGAPTNASPAPPPVILQPTLQPNDQGNPLNTRISAQSANATASMVQQQHPAQQTPINSSATMYSNGASPQLQAQAQAQAQAQAQAQAQAQAQAQAQAQAQAQAQAQAQAQAQAQAHAQAQAQAQAQAQAQAQAQAQQQQQQQQQQQQQQQQQQQQQQQQQQQQQQQLQPLPRQQLQQKGVSVQMLNPQQGQPYITQPTVIQAHQLQPFSTQAMEHPQSSQLPPQQQQLQSVQHPQQLQGQPQAQAPQPLIQHNVEQNVLPQKRYMEGAIHTLVDAAVSSSTHTENNTKSPRQPTHAIPTQAPATGITNAEPQVKKQKLNSPNSNINKLVNTATSIEENAKSEVSNQSPAVVESNTNNTSQEEKPVKANSIPSVIGAQEPPQEASPAEEATKAASVSPSTKPLNTEPESSSVQPTVSSESSTTKANDQSTAETIELSTATVPAEASPVEDEVRQHSKEENGTTEASAPSTEEAEPAASRDAEKQQDETAATTITVIKPTLETMETVKEEAKMREEEQTSQEKSPQENTLPRENVVRQVEEDENYDD

SEQ ID NO: 277 - DNA, 600 bp, Saccharomyces cerevisiae
  CDS (1)..(600)
atggacaaaatcagagaaaagctaagcaacttgaagttggaagccgaatcatggcaggagaagtacgaggagttgaaagagaagaacaaggacttggagcaagagaacgtcgaaaaggagaatcagatcaagtctttaaccgtcaaaaaccagcaattggaggatgagatcgagaagctggaagcgggactttctgactctaagcaaacagaacaggataacgttgaaaaagaaaatcagatcaagtccttgacggtgaagaaccaccaattggaggaagagatcgagaagttggaagcagaattggctgaatccaagcaattgtccgaggactctcaccacttgcagtccaacaacgacaatttctccaagaagaaccagcaattggaagaagacttggaggaaagcgacaccaagctaaaggaaaccactgagaaattgagagagtccgacttgaaggcagatcaattggaaagaagagtagctgccttggaagaacaaagagaagaatgggaaagaaagaacgaggaattgaccgtcaagtacgaagacgcaaagaaggaactggacgaaattgctgcatctctggaaaacttgtga

SEQ ID NO: 278 - protein, 199 aa, Saccharomyces cerevisiae
MDKIREKLSNLKLEAESWQEKYEELKEKNKDLEQENVEKENQIKSLTVKNQQLEDEIEKLEAGLSDSKQTEQDNVEKENQIKSLTVKNHQLEEEIEKLEAELAESKQLSEDSHHLQSNNDNFSKKNQQLEEDLEESDTKLKETTEKLRESDLKADQLERRVAALEEQREEWERKNEELTVKYEDAKKELDEIAASLENL

SEQ ID NO: 279 - DNA, 603 bp, Saccharomyces cerevisiae
  CDS (1)..(603)
atggcaggtatcaagttgacgcataagctttatcagtattatcaattagccacaagctttttgtatgctgcattattgatacggtggctgatattaatgccactggtagggtctcggtttttaccgggaggaatccacgaattcttgatatatttgatgttttattccagcatcatggaagttatttggttgcttagattccacgggttcaaatatggtttgctttcaagaacgtttttgaaagacctaaattttatctatttagtcagcgtgatccatttttatgacgattatgagcatgcattgatcctcaagaatgcatcatattctagtttcattatttccttatctttatcacaggcatattgccattggtgcaaactttttaaacgtaagggcgtaaaggaaagaacacttgtatggaaggttaacacatttgttacattgccaattctctacctgagtgaatttgcattgctactattaaatatccaggttaagaactatcattctaccccgactttggacataatcaacagggtggttttactagcatacttccctgtactactaacagcatacaaaaaactattaacaaaatga

SEQ ID NO: 280 - protein, 200 aa, Saccharomyces cerevisiae
MAGIKLTHKLYQYYQLATSFLYAALLIRWLILMPLVGSRFLPGGIHEFLIYLMFYSSIMEVIWLLRFHGFKYGLLSRTFLKDLNFIYLVSVIHFYDDYEHALILKNASYSSFIISLSLSQAYCHWCKLFKRKGVKERTLVWKVNTFVTLPILYLSEFALLLLNIQVKNYHSTPTLDIINRVVLLAYFPVLLTAYKKLLTK

SEQ ID NO: 281 - DNA, 447 bp, Saccharomyces cerevisiae
  CDS (1)..(447)
atgtgtgaatcatcaaataagactgaaaatgatatagtcagattgtcacaagctatggatgtcctggctaagttgatcatttcaaagcaaaaagatggatcacaattacaagttgagtacgagcataagttgaaagaattagagaaattcattaacctactactgggattgcatgaaagcactgtgggaagtatgatgaatactagtgttcttgacatggtactgcggaatggaatagagatcatggaaaaagacgatcaaaaatatgccctgataccgattaaagccaaggaagaggcagataaaactacgagcactattcagggagtaaccagcaaaaagagtagtaaaaagaaaaaaaataagataaaatgttcattttgtcacgaggctggccacacaagggcacactgcggtgcgagactgacagttatacccaagaaataa

SEQ ID NO: 282 - protein, 148 aa, Saccharomyces cerevisiae
MCESSNKTENDIVRLSQAMDVLAKLIISKQKDGSQLQVEYEHKLKELEKFINLLLGLHESTVGSMMNTSVLDMVLRNGIEIMEKDDQKYALIPIKAKEEADKTTSTIQGVTSKKSSKKKKNKIKCSFCHEAGHTRAHCGARLTVIPKK

SEQ ID NO: 283 - DNA, 1545 bp, Saccharomyces cerevisiae
  CDS (1)..(1545)
atggaggaacaacgtgaaatactggaacaattgaagaaaactctgcagatgctaactgtagagccatctaaaaataaccaaatcgccaacgaagaaaaggaaaagaaagaaaatgaaaattcgtggtgcatcctcgagcacaattatgaggatattgcacaggaattcattgatttcatttacaagaaccctaccacttaccatgtagtatcatttttcgcggagctgttagataagcataacttcaaatacttgagcgagaaatccaattggcaggactccattggcgaagatggtgggaaattctacactataagaaatggaactaacctatctgcctttatcctgggcaaaaactggagagccgaaaagggtgtcggtgtcattggatctcatgtggacgctttgacggtcaaattgaagcccgtctcctttaaagacacagcggaaggttacggaagaattgctgttgctccctatggaggtacactgaatgaattgtggctagacagagacctaggtattggtggtcgccttctttacaagaagaagggcactaacgaaattaaaagcgccttggttgattctacacccctacctgtttgtcgaattccttccttggctccccatttcggtaaacctgctgaaggcccatttgataaagaggaccaaactatcccggtcatcggcttccccactccggatgaggaaggtaatgaacctcccacggatgatgaaaagaaatcgcccttatttggcaaacactgcatccacctgttaaggtacgttgccaaattagccggtgtggaagtgtccgaattgattcaaatggatttagacttattcgatgtgcaaaagggtaccattggaggtattggtaaacacttcctttttgcaccacgtctagatgacaggttgtgtagtttcgcagcaatgattgctttgatttgctacgctaaggatgttaataccgaggaatcagatttattctctactgtcactttgtatgataatgaagaaatcggatcgttgacaagacaaggcgcaaaaggtggcttgttggagtcagtggtggaacgcagttcttctgcattcactaagaaaccggtcgatttgcatacggtttgggctaattccatcatcttgtccgcagacgtcaaccacctctacaacccaaactttcctgaagtctatttgaagaatcattttccagtgcctaatgtcggaatcactttatcactggatcctaacggtcatatggccacagatgtcgtaggaactgccctagtagaagaattagcacgccgcaatggagacaaagtgcaatatttccaaatcaaaaacaactcaagatcaggtggtactatcggcccatcattggcttctcaaacaggtgctcgtaccatagacctgggaattgcacagttgtccatgcacagcatcagagctgctacagggtccaaggatgtcggattaggtgttaagttcttcaacggatttttcaagcactggagatcagtctacgatgaattcggcgagttgtga

SEQ ID NO: 284 - protein, 514 aa, Saccharomyces cerevisiae
MEEQREILEQLKKTLQMLTVEPSKNNQIANEEKEKKENENSWCILEHNYEDIAQEFIDFIYKNPTTYHVVSFFAELLDKHNFKYLSEKSNWQDSIGEDGGKFYTIRNGTNLSAFILGKNWRAEKGVGVIGSHVDALTVKLKPVSFKDTAEGYGRIAVAPYGGTLNELWLDRDLGIGGRLLYKKKGTNEIKSALVDSTPLPVCRIPSLAPHFGKPAEGPFDKEDQTIPVIGFPTPDEEGNEPPTDDEKKSPLFGKHCIHLLRYVAKLAGVEVSELIQMDLDLFDVQKGTIGGIGKHFLFAPRLDDRLCSFAAMIALICYAKDVNTEESDLFSTVTLYDNEEIGSLTRQGAKGGLLESVVERSSSAFTKKPVDLHTVWANSIILSADVNHLYNPNFPEVYLKNHFPVPNVGITLSLDPNGHMATDVVGTALVEELARRNGDKVQYFQIKNNSRSGGTIGPSLASQTGARTIDLGIAQLSMHSIRAATGSKDVGLGVKFFNGFFKHWRSVYDEFGEL

SEQ ID NO: 285 - DNA, 579 bp, Saccharomyces cerevisiae
  CDS (1)..(579)
atgtctgaaaaggccgttagaaggaaacttgttattattggtgatggtgcttgtggcaagacctctttactatatgtatttacattaggaaaattccctgaacaatatcatccgacagtgttcgagaattatgtcactgattgcagagttgacggaataaaagtgtccttaacgctctgggatacagcgggacaagaggaatatgaacgtttacgtccattctcatattcaaaagcagatataatattaattgggtttgctgtagacaattttgaatcactaattaacgcaaggacgaaatgggcggatgaggcattacgatattgtcctgacgcaccaatcgttcttgtaggcttgaaaaaagatttgaggcaagaagcccattttaaagagaatgctaccgatgaaatggttcccattgaagatgcaaaacaagttgcaagggccattggggccaagaaatacatggaatgtagtgcactgactggtgagggtgtggatgatgtctttgaagtagctacaagaaccagtttgcttatgaagaaggaaccaggggctaactgttgcataattttataa

SEQ ID NO: 286 - protein, 192 aa, Saccharomyces cerevisiae
MSEKAVRRKLVIIGDGACGKTSLLYVFTLGKFPEQYHPTVFENYVTDCRVDGIKVSLTLWDTAGQEEYERLRPFSYSKADIILIGFAVDNFESLINARTKWADEALRYCPDAPIVLVGLKKDLRQEAHFKENATDEMVPIEDAKQVARAIGAKKYMECSALTGEGVDDVFEVATRTSLLMKKEPGANCCIIL

SEQ ID NO: 287 - DNA, 792 bp, Saccharomyces cerevisiae
  CDS (1)..(792)
atgatcgctacctccagagccgtaaacatgaataaagaatcaaaacacaagaaggctgttgccaaaccatgcagagagagacaaacttcagttacaagagccatgagaccagctgtagcacgtgatcctcgcagactttcgacgtcgtcgtctccttcttcgtcaccaatgtcagcacagagaaggctttcgagggaagaaataataaacgaaatggaaaaggagcaagacgctattgtagtaagacttctacgggaaattgaaactttaaaagaagaaaactctaggttaaaaaatcaactgcaccatccggtcccggctagaaggtcgtctccatttttcgaaggcgagtctgccatcctagatgatgatgactgcaattatggttacaccctcgacactccaaagctaaagctcacagatggtgcatccagacacaccgtacttcccttaacacccaaggactccatgacccacatttcccattccgccagaaggtcaagccggaacgcttccatatctaacggaacaagcatctcagacacgattttccccattgagactaaaatccactcagcaccaacaacaaacagaaaccttccctccgccgatcttccacatcacactcttcttccacgttctctaagcggcatttcgtctagcgatttaaccgaatccggtgctcttcttcatgacaggagaaggcgttcttccaattacagtctcgatggctcaaactctttaaaggctgatctcatggcaaagagattccaaactggttcattgaaatag

SEQ ID NO: 288 - protein, 263 aa, Saccharomyces cerevisiae
MIATSRAVNMNKESKHKKAVAKPCRERQTSVTRAMRPAVARDPRRLSTSSSPSSSPMSAQRRLSREEIINEMEKEQDAIVVRLLREIETLKEENSRLKNQLHHPVPARRSSPFFEGESAILDDDDCNYGYTLDTPKLKLTDGASRHTVLPLTPKDSMTHISHSARRSSRNASISNGTSISDTIFPIETKIHSAPTTNRNLPSADLPHHTLLPRSLSGISSSDLTESGALLHDRRRRSSNYSLDGSNSLKADLMAKRFQTGSLK

SEQ ID NO: 289 - DNA, 576 bp, Saccharomyces cerevisiae
  CDS (1)..(576)
atggcctcctcaagtagcacgctaccgcttcatatgtatattagacccttaatcattgaagatttaaagcagattttgaacttggaaagccaaggtttcccaccaaacgaaagagcttcagaagaaattatcagctttcgtttgatcaattgtccagagctatgttcaggtcttttcatcagagagatcgagggcaaagaagttaaaaaggagacactaattggtcatattatgggtactaagatacctcatgaatacattactatcgaaagcatgggcaaattacaagtggaatcgagtaatcatattggtattcactctgtagtaatcaagccagaataccagaaaaaaaacctggctactttacttttaactgactacattcagaaattgagtaatcaggaaattggtaacaaaattgtccttattgctcacgagccattgataccattttatgaaagagttggtttcaagatcattgctgagaacaccaatgttgctaaggacaaaaacttcgcagaacagaaatggatcgatatggagagagaactaattaaggaagaatacgacaactag

SEQ ID NO: 290 - protein, 191 aa, Saccharomyces cerevisiae
MASSSSTLPLHMYIRPLIIEDLKQILNLESQGFPPNERASEEIISFRLINCPELCSGLFIREIEGKEVKKETLIGHIMGTKIPHEYITIESMGKLQVESSNHIGIHSVVIKPEYQKKNLATLLLTDYIQKLSNQEIGNKIVLIAHEPLIPFYERVGFKIIAENTNVAKDKNFAEQKWIDMERELIKEEYDN

SEQ ID NO: 291 - DNA, 789 bp, Brassica napus
  CDS (1)..(789)
atggccgtcgggaagaacaagcgaatctccaaaggaagaaagggaggcaagaagaagattgttgatcctttctccaagaaggattggtatgacatcaaggctccctctaacttcactcacagaaatgtcggaaagacacttgtttctagaactcagggtaccaagattgcatcagagggtttgaaacacagagttttcgaggtgtctcttgctgatctccaaggtgatgaggataatgcttacaggaagatccgtctcagagctgaagatgtccagggaaggaatgtcttgacccagttctggggaatggacttcaccactgataaactcagatccttggtgaaaaagtggcagactttgattgagtgtcacgttgatgttaaaaccactgacaacttcactctgaggcttttctgcattgctttcaccaagagacgtgctaaccaagtcaagagaacttgctacgctcaatccagccaaatccgtgagattcgcagcaagatgagggagataatgatcaaggaagcttcctcttctgacctcaaggagcttgttgccaagtttattccagaatctattgggaaagagattgagaaggcaactcagggaatctaccctcttcaaaatgttttcatccgtaaagtcaagatcctcaaggctcccaaattcgaccttggaaagctcatggaggttcacggagactacacagcagaggatgttggtgtgaaggttgacaggcctgctgatgagacagtggtcgaagaacctactgagatcattggagcttaa

SEQ ID NO: 292 - protein, 262 aa, Brassica napus
MAVGKNKRISKGRKGGKKKIVDPFSKKDWYDIKAPSNFTHRNVGKTLVSRTQGTKIASEGLKHRVFEVSLADLQGDEDNAYRKIRLRAEDVQGRNVLTQFWGMDFTTDKLRSLVKKWQTLIECHVDVKTTDNFTLRLFCIAFTKRRANQVKRTCYAQSSQIREIRSKMREIMIKEASSSDLKELVAKFIPESIGKEIEKATQGIYPLQNVFIRKVKILKAPKFDLGKLMEVHGDYTAEDVGVKVDRPADETVVEEPTEIIGA

SEQ ID NO: 293 - DNA, 594 bp, Brassica napus
  CDS (1)..(594)
atgagcgcatcgaggttcataaagtgtgtgaccgttggtgacggagctgtgggtaaaacatgtctcctcatttcttacaccagcaacactttccctacggattatgttccgactgtttttgataacttcagcgctaatgtggttgttaacggagccactgtcaaccttggcttgtgggataccgctgggcaggaggattataacaggttaagaccattgagttaccgcggtgctgatgttttcatcttagccttctccctcatcagtaaggctagttatgagaatgtctccaagaagtggatccctgagctgactcactatgcccctggtgtcccaattgttcttgttggtaccaaactagatcttagggatgacaaacagttcttcgttgaccaccctggtgctgtacctattaccactgctcagggagaggaactgatgaagctaattggagctccttcgtacatcgagtgcagttcaaaatcacaggagaacgtgaagggggtgtttgatgcagcgattagagtggtacttcaacctccaaagcagaagaaaaagaagggcaaagtacaaaaggcctgctccattttgtaa

SEQ ID NO: 294 - protein, 197 aa, Brassica napus
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELTHYAPGVPIVLVGTKLDLRDDKQFFVDHPGAVPITTAQGEELMKLIGAPSYIECSSKSQENVKGVFDAAIRVVLQPPKQKKKKGKVQKACSIL

SEQ ID NO: 295 - DNA, 450 bp, Brassica napus
  CDS (1)..(450)
atggcggatcagctcaccgacgatcagatctctgagttcaaggaagccttcagcttattcgacaaggatggtgacggttgcattactaccaaggagcttggaaccgtgatgcgttctctcggacagaacccaacagaagcagagctccaagacatgatcaacgaagttgacgctgacggtaacggaaccattgattttcctgagttcttgaacctcatggctcgtaagatgaaggacaccgactccgaggaagagctcaaggaagcgttcagggtcttcgacaaggatcagaacggtttcatctcagctgctgagctccgccatgtgatgacaaacttaggtgagaagctcacagatgaagaggttgacgagatgattaaggaagctgatgttgatggtgatggccagattaactatgaggagtttgtcaaggtcatgatggctaagtga

SEQ ID NO: 296 - protein, 149 aa, Brassica napus
MADQLTDDQISEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIKEADVDGDGQINYEEFVKVMMAK

SEQ ID NO: 297 - DNA, 411 bp, Brassica napus
  CDS (1)..(411)
atggctcgtacgaagcaaaccgcaagaaaatccaccggaggaaaagctcccaggaagcagctcgccaccaaggcggcgaggaagtctgcaccgaccaccggaggagtgaagaagcctcaccgttaccgtcccggaaccgtggctcttcgtgagattagaaagtaccagaagagtacggagttgctgatccgtaaactccccttccagcgtcttgttcgcgagattgctcaggactttaagacggatctgaggtttcagagccacgctgttttagctcttcaggaggcggcggaggcttatcttgtgggtctgttcgaggacaccaatctctgtgctattcacgctaagagggttaccatcatgcccaaggatattcaattggccagaaggattcgtggagaacgtgcttaa

SEQ ID NO: 298 - protein, 136 aa, Brassica napus
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 299 - DNA, 375 bp, Brassica napus
  CDS (1)..(375)
atgatcctattcatattattgcagaacagacaaggcaagacccgtcttgcaaattactatgttcctcttgaggagtctgagaaacacaaagtcgaatacgaggttcacagattggtggtaaatcgcgactcgaagttcaccaatttcgttgagtttagaacgcataaggttatatacaggcgctatgcaggcctgtttttctccttgtgcgttgacataacagacaatgagttggcttaccttgaatgtatctacttgttcgtcgagattttggacaatttcttcagcaatgtctgtgagcttaatttggttttcaacttccacaagcaaattcttcaactaagggcttcctggatgattcttgtttggccttag

SEQ ID NO: 300 - protein, 124 aa, Brassica napus
MILFILLQNRQGKTRLANYYVPLEESEKHKVEYEVHRLVVNRDSKFTNFVEFRTHKVIYRRYAGLFFSLCVDITDNELAYLECIYLFVEILDNFFSNVCELNLVFNFHKQILQLRASWMILVWP

SEQ ID NO: 301 - DNA, 411 bp, Brassica napus
  CDS (1)..(411)
atggctcgtaccaagcagaccgctcgtaagtctaccggaggaaaggccccgaggaagcagcttgctactaaggccgctcgtaagtctgcaccaaccaccggaggagtcaagaagccacatcgttacagacctggaactgttgctcttcgtgagatccgtaagtaccagaagagtactgagctgttgatcaggaagcttcctttccagaggcttgttcgtgagattgctcaggacttcaagactgacctgcgtttccagagccatgcggtgctagcactccaggaggcagctgaagcataccttgtgggactctttgaggacactaacctgtgcgccattcacgccaagcgtgtgaccatcatgcccaaggacatccagctcgctcgcaggatcagaggagagcgtgcttaa

SEQ ID NO: 302 - protein, 136 aa, Brassica napus; identical to SEQ ID NO: 298

SEQ ID NO: 303 - DNA, 591 bp, Brassica napus
  CDS (1)..(591)
atgagcgcatcgaggttcataaagtgtgttacagtcggcgatggtgccgtcggaaaaacctgtatgctgatctcttacaccagcaacactttccctacggactatgttccaactgttttcgacaacttcagtgctaacgtggttgttgatgggaacactgtgaatcttggattgtgggatacagctggtcaagaagactataacaggttaagaccattgagttaccgtggtgcagatgtcttcattcttgctttctctcttattagcaaagctagctacgagaacatagccaagaagtggattcctgagctcaggcattatgcccctggagttcctatcattctcgtggggacaaaactcgatcttcgagatgacaagcagttcttcatagaccatcccggtgcagtgccaatcactacaaaccagggagaggaactaaagaaactcataggatctccagtttacattgaatgtagttcaaagacgcagcagaatgtcaaagcagtctttgacgcagctattaaagtggtgcttcagccaccaaaatcaaagaagaagaaaaagaacaagaatcgttgcgttttcttgtga

SEQ ID NO: 304 - protein, 196 aa, Brassica napus
MSASRFIKCVTVGDGAVGKTCMLISYTSNTFPTDYVPTVFDNFSANVVVDGNTVNLGLWDTAGQEDYNRLRPLSYRGADVFILAFSLISKASYENIAKKWIPELRHYAPGVPIILVGTKLDLRDDKQFFIDHPGAVPITTNQGEELKKLIGSPVYIECSSKTQQNVKAVFDAAIKVVLQPPKSKKKKKNKNRCVFL

SEQ ID NO: 305 - DNA, 411 bp, Brassica napus
  CDS (1)..(411)
atggctcgcaccaagcagacggcaaggaaatcaaccggaggcaaggccccaaggaagcagctagcaacaaaagcagcgaggaaatcagctccagccaccggaggagtgaagaagccgcacagattcaggccaggaacagtggctctaagagagatcaggaagtaccagaagagcaccgagctcctgatccgcaagctcccgttccagaggctagtgagagagatcgctcaggatttcaagacggatctccgtttccagagcagcgccgtcgccgctctccaggaagctgccgaggcttacctcgtcggactgtttgaggatactaatctgtgtgcgatccacgccaagagggtgacgatcatgcctaaggacatacagctcgccagaagaatcagaggtgaaagggcttag

SEQ ID NO: 306 - protein, 136 aa, Brassica napus
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 307 - DNA, 447 bp, Brassica napus
  CDS (1)..(447)
atgggcaaggacggcctgagcgacgaccaggtgtcatcgatgaaggaggccttcacgctcttcgacaccaacggcgacggcaaaatcgccccgaccgagctcgggatcctcatgcgatcgctcggcgggaacccgacccaagcccagctgaaatcaatcaccgcctccgaaaacctaaccgctccgttcgatttcgaccggtttttggatctcatggcgaagcacctgaagacggagcctttcgatcgccagctccgcgacgccttcaaggtgctcgacaaggaaggcactgggttcgtggcagtggcggatctgaggcatatcttgacaagtatcggggagaagctggagcctaacgagtttgatgagtggatcaaggaggtggatgtggggtccgatgggaagatcaagtatgaggatttcattgccaggatggttgctaagtga

SEQ ID NO: 308 - protein, 148 aa, Brassica napus
MGKDGLSDDQVSSMKEAFTLFDTNGDGKIAPTELGILMRSLGGNPTQAQLKSITASENLTAPFDFDRFLDLMAKHLKTEPFDRQLRDAFKVLDKEGTGFVAVADLRHILTSIGEKLEPNEFDEWIKEVDVGSDGKIKYEDFIARMVAK

SEQ ID NO: 309 - DNA, 1041 bp, Brassica napus
  CDS (1)..(1041)
atgcctccgaaagcgaaagcgaaggatgcaggtccagtagagaggcctatccttggccgtttctcttctcacctcaagatcggaatcgttgggttaccaaacgtgggaaagtcaacacttttcaacacactaacgaagctttcaatcccagctgagaacttccccttttgtaccattgagcccaacgaggcacgcgtcaatatccccgatgacaggtttgattggctttgccagttgtacaagcccaagagtgagattccagctttcttggaaattcatgacattgctggccttgttagaggcgctcatgaagggcagggacttggaaacaacttcttgtcccatattcgtgccgttgatgggatcttccatgtcttacgtgcgtttgaagatcctgatattattcatgttgatgatattgtggatcctgttagagatttggagaccattactgaagaattgcgactaaaggatattgaattcattaaaaagaagattgaagatgtcgagaagagcatgaagaggagcaatgacaaggcgcttaaagttgaacttgagctcttgctaaaggtgaaagcttggctggaagaaggaaaggatgtccgttttggagactggaaagcagctgatatcgagattttgaacactttccaattgctttccgcaaagcccgttgtttacttgattaacatgaatgagagagattatcagaggaagaaaaacaagttcttgccaaagattcatgcttgggttcaagaacacggtggtgatactatgattcctttcagtggtgtttttgaaaggactctcgctgatatgctcccagacgaagcagcaaagtattgtgaggagaacaaactacaaagtgctcttccgaggatcatcaaaactggattttcagccattaacctcatatatttctttacagcgggacctgatgaggtgaagtgctggcaaataagacgtcagtcaaaggctcctcaagctgcaggggccattcatactgattttgagagaggatttatttgtgctaggtcatga

SEQ ID NO: 310 - protein, 346 aa, Brassica napus
MPPKAKAKDAGPVERPILGRFSSHLKIGIVGLPNVGKSTLFNTLTKLSIPAENFPFCTIEPNEARVNIPDDRFDWLCQLYKPKSEIPAFLEIHDIAGLVRGAHEGQGLGNNFLSHIRAVDGIFHVLRAFEDPDIIHVDDIVDPVRDLETITEELRLKDIEFIKKKIEDVEKSMKRSNDKALKVELELLLKVKAWLEEGKDVRFGDWKAADIEILNTFQLLSAKPVVYLINMNERDYQRKKNKFLPKIHAWVQEHGGDTMIPFSGVFERTLADMLPDEAAKYCEENKLQSALPRIIKTGFSAINLIYFFTAGPDEVKCWQIRRQSKAPQAAGAIHTDFERGFICARS

SEQ ID NO: 311 - DNA, 762 bp, Brassica napus
atggttggaccaggaagacctcaaatcgtcctcttcggttcatcaatcgttcaatacagcttcagcgatggtggatggggagccactctcgctaacatctactctcgcacggctgacgtaatccttcgtgggtatgctggttggaactccagatctgccttgaaggtgttaaaccaagtgttcccaaaggatgctgttatacaaccttctttggtgatagtctatttcggagggaatgattcaatgcctcctcatccatcagggcaaggacctcatgttcctctctctgaattcactgagaacatgaggaagatcggagagcatcttttgagcctctcggacaagacccgtgtcatttttctcactcccccaccaatgaacgagagacaaatccaactagtgtttggagatgcaatgagaggccggagtaacgagctgtgtcgtccatacgcagaagcgttgttgaatctatgcagagagatcaatgtgaaaggtatcgatctttggaacgcaatacagcaacaagatgattggttacacacttgcttcactgacggtatccatttcacggccaaggcgagcgagattgtggtgaaggagatattgaaagtagtgagagaagctgattggaaaccgagtcttgacaggaagtcattaccggttgagtttccatttgattctggtctaccaaactccccaagacatagtgatctagaattaactagaaacaagaagttggagcctcgtatggcccgattgtaa

SEQ ID NO: 312 - DNA, 733 bp, Brassica napus
  CDS (1)..(594)
atgagcgcatctcggttcataaagtgcgtgacggtcggtgacggagcagtgggcaaaacatgtctcctcatctcttacaccagcaacactttccctacggattatgtgcccactgttttcgataactttagcgctaacgttgttgttaacggagccactgtcaacttaggactctgggatacagcagggcaggaggattataacagattgagacccttgagttaccgcggtgctgacgttttcatcttagccttctctcttatcagtaaggctagttatgagaatgtctccaagaagtggatccctgagctgacccactatgcccctggtgtccctattgttcttgttggaaccaaactagatcttagggatgacaaacagttcttcgttgaccaccctggtgctgtacctattaccactgctcagggcgaggaactaatgaagctaattggagctccttcgtacatcgagtgcagctcaaaatcacaggagaacgtgaagggggtgtttgatgcagcgatcagagtggtacttcaacctccaaagcagaagaaaaagaagagcaaagctcaaaaggcctgctccattttgtgatttctctacgctcatctctcttccactctctagtgaaggcttaagaagaagaaacactttagcctttaagatttggttcagagttcgttgtgataagcctcgcttaatccttagaaacgattacttctggttttactga

SEQ ID NO: 313 - protein, 197 aa, Brassica napus
MSASRFIKCVTVGDGAVGKTCLLISYTSNTFPTDYVPTVFDNFSANVVVNGATVNLGLWDTAGQEDYNRLRPLSYRGADVFILAFSLISKASYENVSKKWIPELTHYAPGVPIVLVGTKLDLRDDKQFFVDHPGAVPITTAQGEELMKLIGAPSYIECSSKSQENVKGVFDAAIRVVLQPPKQKKKKSKAQKACSIL

SEQ ID NO: 314 - DNA, 411 bp, Brassica napus
  CDS (1)..(411)
atggctcgtaccaagcaaaccgctagaaaatccaccggaggaaaggctccgaggaagcagctggcgacgaaagcggcgaggaagtcggctccggccacgggaggagtgaagaagccgcacagattccgtcccggaaccgtcgcccttcgtgagatcaggaagtaccagaagagcaccgagcttctcatccgcaagcttcccttccagcgtctggtccgtgagatcgctcaggacttcaagatggatctgaggttccagagcagcgccgtcgcggctttgcaagaggctgctgaggcttaccttgttggtttgttcgaagacaccaatctctgcgcgattcacgccaaaagagtgacgatcatgcccaaggatatccagctcgctaggagaatccgtggtgaaagagcttga

SEQ ID NO: 315 - protein, 136 aa, Brassica napus
MARTKQTARKSTGGKAPRKQLATKAARKSAPATGGVKKPHRFRPGTVALREIRKYQKSTELLIRKLPFQRLVREIAQDFKMDLRFQSSAVAALQEAAEAYLVGLFEDTNLCAIHAKRVTIMPKDIQLARRIRGERA

SEQ ID NO: 316 - DNA, 606 bp, Brassica napus
  CDS (1)..(606)
atgagcacagcgagattcatcaagtgtgtgacggtcggagatggagctgtggggaagacttgtatgctgatttcatataccagcaatacttttcctacggattacgttccgacagtttttgacaatttcagtgcgaatgtggtggtcgatggaagtactgtcaacctcggcctgtgggatactgctgggcaggaagattataacaggcttcggcctttgagttacagaggagcagatgtgtttttattggcattttccctaattagcaaggccagttacgagaacatttacaaaaagtggcttccggagctgaaacattatgcgcctagcatccccattgtactcgtcggaaccaagttagatttgagggatgacaaacagttcttgaaagatcatccaggagcagcttcaataacaactgcccagggagaggaattaagaaagatgattggagccatcaagtacttagaatgcagctccaaaacccagcagaatgtgaaggcagtgtttgatacagcgatccgggtagcgttgaggcctccaaaggcaaagaagaagataaagccattgaggaccaaaagatcaagaacatgctttttcttctaa

SEQ ID NO: 317 - protein, 201 aa, Brassica napus
MSTARFIKCVTVGDGAVGKTCMLISYTSNTFPTDYVPTVFDNFSANVVVDGSTVNLGLWDTAGQEDYNRLRPLSYRGADVFLLAFSLISKASYENIYKKWLPELKHYAPSIPIVLVGTKLDLRDDKQFLKDHPGAASITTAQGEELRKMIGAIKYLECSSKTQQNVKAVFDTAIRVALRPPKAKKKIKPLRTKRSRTCFFF

SEQ ID NO: 318 - DNA, 327 bp, Brassica napus
  CDS (1)..(327)
atgagtaggccaatggaagaggataccaacgggaaaaccgaagaggaggagttcaacaccggacccctttctgttctgatgatgagtgttaagaacaacactcaggtgttgatcaactgccgcaacaacaggaaactccttggccgtgttagggctttcgacaggcactgcaacatggttcttgaaaatgtcagggaaatgtggactgaggtacctaaaactgggaaaggaaagaagaaagctcttcccgtcaacagagatcgctttatcagcaagatgtttcttcgtggtgactctgtcatcatcgtccttaggaatcccaagtaa

SEQ ID NO: 319 - protein, 108 aa, Brassica napus
MSRPMEEDTNGKTEEEEFNTGPLSVLMMSVKNNTQVLINCRNNRKLLGRVRAFDRHCNMVLENVREMWTEVPKTGKGKKKALPVNRDRFISKMFLRGDSVIIVLRNPK

SEQ ID NO: 320 - DNA, 636 bp, Brassica napus
  CDS (1)..(636)
atgtcagcttcagtggctgctgcatcagtatcaacaacaacaacagcagctacaacgtttatcaagtgcgtcactgttggcgatggagctgtgggcaaaacttgtcttcttatctcctacaccagcaacacctttcctactgattatgttcctacagtgttcgacaacttcagtgcaaatgttctagtcgatggcaaaaccgtcaatcttggtctttgggatactgctggtcaagaagattacaataggcttagaccattgagttacagaggagcagatgttttcattcttgccttttctcttatcagcaggcctagctttgagaacattgctaaaaagtgggtccctgagctgcgacattatgcccctaacgtgcctattgttctagtgggaactaaattagatctaagagaggataagaagttcccaatgaactatccaggtgcttgcacaatctcaacagaacaaggtcaagagctaagaaaagagataggagcattagcatatatagagtgcagctcaaaaacacaacagaacgtgaaagcggtgtttgatgcagcgataaaagtagttctacagcctcctacaaaaattaagaaacaaaagagaagatttcgtttctgccatgctctctga

SEQ ID NO: 321 - protein, 211 aa, Brassica napus
MSASVAAASVSTTTTAATTFIKCVTVGDGAVGKTCLLISYTSNTFPTDYVPTVFDNFSANVLVDGKTVNLGLWDTAGQEDYNRLRPLSYRGADVFILAFSLISRPSFENIAKKWVPELRHYAPNVPIVLVGTKLDLREDKKFPMNYPGACTISTEQGQELRKEIGALAYIECSSKTQQNVKAVFDAAIKVVLQPPTKIKKQKRRFRFCHAL

SEQ ID NO: 322 - DNA, 297 bp, Brassica napus
  CDS (1)..(297)
atgatgaagcgtctggtcccaacgttcaaccgcatcctggtgcagagagtcatccagcctgctaaaaccgagagcggcatcctcctcccagagaaagcctcctcgttgaactcgggcaaggtgatagcagtgggacctggttcaagggacaaagatgggaaattgattccggtctctgtcaaggaaggcgacaccgttcttcttccagagtacggcggtactcaggtcaagctcggcgagaaagagtaccatctcttccgtgatgaggacgtcttgggaacattgcacgaggattga

SEQ ID NO: 323 - protein, 98 aa, Brassica napus
MMKRLVPTFNRILVQRVIQPAKTESGILLPEKASSLNSGKVIAVGPGSRDKDGKLIPVSVKEGDTVLLPEYGGTQVKLGEKEYHLFRDEDVLGTLHED

SEQ ID NO: 324 - DNA, 1032 bp, Brassica napus
  CDS (1)..(1032)
atgggttcgctcaaggacggtcaaagaagggacttggagggaggagaagaagaatcggaggagccgctattaacggcgcagaaccagaggttcactatgttcccaattaggtacaagtcgatttgggagatgtataagaaggctgaggccagcttctggactgctgaagaagttgatctttcgacggatgtgcagcactgggaaaagttgtcggattcagagaaacatttcatcagccatgttctggcctttttcgcggcatcagatgggattgttttggagaatttggccgctaggttcttgaatgatgtccaagtccctgaggctcgtgctttctatgggtttcaaattgccatggagaacattcattctgagatgtacagccaacttctggagacgtttataaaggattcgcaggagaaggatagattgttcaatgctattgagaccattccctgcatttccaacaaggctaaatggtgtttagattggattcaaagtcctatgtcttttgctgtgaggcttgttgcttttgcatgcgtcgaaggaatcttcttctccggaagcttctgtgccatcttctggctgaagaagagaggtcttatgcctggtttgactttctcaaacgagcttatatcgagagacgagggtctccactgtgactttgcatgtctcttgtacagtttgcttcagaagcagcttcctgtggagaaagtttatcagattgttcatgaggcagtggaaattgagacagagtttgtctgcaaggccctttcatgcgatctgattggaatgaactcaaacctcatgagtcagtacatacaatttgtcgcagaccgtcttctggttacattgggatgtgaaaggagatacaaagcagataatccatttgactggatggagttcatatctctccgagggaagacaaacttctttgagaagagagtgggagagtatcagaaagcatctgttatgtcaagcctccaagaaggtaataagaactacgaattcaagattgatgaggacttttga

SEQ ID NO: 325 - protein, 343 aa, Brassica napus
MGSLKDGQRRDLEGGEEESEEPLLTAQNQRFTMFPIRYKSIWEMYKKAEASFWTAEEVDLSTDVQHWEKLSDSEKHFISHVLAFFAASDGIVLENLAARFLNDVQVPEARAFYGFQIAMENIHSEMYSQLLETFIKDSQEKDRLFNAIETIPCISNKAKWCLDWIQSPMSFAVRLVAFACVEGIFFSGSFCAIFWLKKRGLMPGLTFSNELISRDEGLHCDFACLLYSLLQKQLPVEKVYQIVHEAVEIETEFVCKALSCDLIGMNSNLMSQYIQFVADRLLVTLGCERRYKADNPFDWMEFISLRGKTNFFEKRVGEYQKASVMSSLQEGNKNYEFKIDEDF

SEQ ID NO: 326 - DNA, 789 bp, Brassica napus
  CDS (1)..(789)
atggccgtcgggaagaacaagagaatctctaaaggaagaaagggagggaagaagaagattgttgatcctttctccaagaaggattggtatgacatcaaggctccctctaacttcaataacagaaatgtcggaaagacacttgtttctagaactcagggtaccaagattgcatcagagggtttgaaacacagagttttcgaggtttctcttgctgatctccaaggtgatgaggatcacgcttacaggaagatccgtctcagagctgaagatgtccagggcaggaatgtgttgacccagttctggggtatggacttcacaaccgacaagctcaggtccttggttaaaaagtggcagactttgatcgagtctcatgtcgatgtcaaaaccactgataactacacactgaggcttttctgcatcgccttcaccaagagacgtgctaaccaagtcaagagaacttgctatgctcaatccagccaaatccgtcagattcgcagcaagatgagggagatcatgatcaaggaagcttcgtcttgtgacctcaaggagcttgttgccaagtttattcccgaagctattgggaaggatattgagaaggcgactcagggcatctaccctcttcagaatgttttcatccgtaaagtcaagatcctcaaggctcccaagttcgacctcggaaagctcatggaggttcacggagactacacagcagaggatgttggtgtcaaggttgacaggccggccgatgagactgctgccgaggaacctactgagatcattggagcttaa

SEQ ID NO: 327 - protein, 262 aa, Brassica napus
MAVGKNKRISKGRKGGKKKIVDPFSKKDWYDIKAPSNFNNRNVGKTLVSRTQGTKIASEGLKHRVFEVSLADLQGDEDHAYRKIRLRAEDVQGRNVLTQFWGMDFTTDKLRSLVKKWQTLIESHVDVKTTDNYTLRLFCIAFTKRRANQVKRTCYAQSSQIRQIRSKMREIMIKEASSCDLKELVAKFIPEAIGKDIEKATQGIYPLQNVFIRKVKILKAPKFDLGKLMEVHGDYTAEDVGVKVDRPADETAAEEPTEIIGA

SEQ ID NO: 328 - DNA, 840 bp, Brassica napus
  CDS (1)..(840)
atgtcgtccggtttaatcggaagattagtcggaaccaaaccgtcgcgattaaccaccgcagcaaggttgatcccgtcgcgatgcacagcctccgtaaccgaaccggaaccaaaagcgtcctctggcggcggaaaaccatcgaacttcaaaactttccagatctaccgatggaaccccgacaaccctagcaagcctgagctccaagactacaagatcgacctcaaagactgcggccccatggttctcgacgccttgatcaaaatcaagaacgagatggatccgtctctcaccttccgccgctcgtgccgagaagggatctgcggctcgtgcgcgatgaacatcgacgggtgcaacgggctcgcgtgtctgacgaagatcgaggagggagccaaggagacgacgatcactcccttgcctcacatgttcgtgatcaaggatctggtggtggacatgactaacttttataatcagtacaagagtattgagccgtggctgaagaggaagaaccctccgtctgagcctgggaaggagattctgcagagtaagaaggatagggctaagcttgatgggatgtatgagtgtattctctgcgcttgttgtagcacgtcttgtcctagttactggtggaaccctgagtcttaccttggccctgccgctttgctacatgccaataggtggataagcgacagtcgtgatgagtacactaaggaaagacttgaggctattgacgatgagttcaagctttaccgttgtcatacgatcttgaactgtgctcgtgcttgtcctaagggtttgaacccgggcaaacagatcgcgcacattaagcaacttcagcgttga

SEQ ID NO: 329 - protein, 279 aa, Brassica napus
MSSGLIGRLVGTKPSRLTTAARLIPSRCTASVTEPEPKASSGGGKPSNFKTFQIYRWNPDNPSKPELQDYKIDLKDCGPMVLDALIKIKNEMDPSLTFRRSCREGICGSCAMNIDGCNGLACLTKIEEGAKETTITPLPHMFVIKDLVVDMTNFYNQYKSIEPWLKRKNPPSEPGKEILQSKKDRAKLDGMYECILCACCSTSCPSYWWNPESYLGPAALLHANRWISDSRDEYTKERLEAIDDEFKLYRCHTILNCARACPKGLNPGKQIAHIKQLQR

SEQ ID NO: 330 - DNA, 1074 bp, Brassica napus
  CDS (1)..(1074)
atgggagaggtccttaagaaggaggcgtacggactggctgtaaaagacgaatctggagttatctcgcctttccgtttctcaagaagggagacaggagaaaatgatgtgaggttaaaagtgttgttctgtggaatttgccacacagatttaagcatggccataaacgagtgggggtttactagttacccccttgtccccgggcatgaaatagtgggcgtggtgactgaagtcggagccaaagtgactaaattcaacgccggagacaaagtgggagttggttatatggtcagctcatgcgggtcatgtgaaacctgcattgatgaccaagagaactactgtccaaaaatgatcctaacgtccggaggcaagtattacgatgacactataacatatggtggttactccgaccatatggtttgtgaagaggactacatcatccgtattccagaaaatcttcccttagacgctaccgcgccgctactctgcgctgggaccaccgtctattccccgatgaagtatcacgggcttgacaagccgggtatgcacattggtgtggtgggactaggcggtttaggtcatgtagctgtgaaatttgctaaggctatgggtactaaggttacagttattagtacttcggataggaagagagacgaggcgttaactcggcttggtgcggatctgttcttggtgagccgtgacccggaacagatgaaggatgcaatgggtactatggatggtattattgataccgtatctgcttctcatccagttcttccgattcttgatttgcttaaatataagggtaaacttattatggttggtgcacctgataaaccgcttgagcttccggttctgcctctcatctttgggaaaaagatggtggtgggaagtatggtaggagggataaaagagactcaagagatgatggatttggccggaaaacacaacatcacggcagatattgagcttatctctgcggattatgtcaacactgccatgaaacggctcgagaaggctgacgttagataccgttttgtgattgatgttgccaacaccttgaagcctagtccttaa

SEQ ID NO: 331 - protein, 357 aa, Brassica napus
MGEVLKKEAYGLAVKDESGVISPFRFSRRETGENDVRLKVLFCGICHTDLSMAINEWGFTSYPLVPGHEIVGVVTEVGAKVTKFNAGDKVGVGYMVSSCGSCETCIDDQENYCPKMILTSGGKYYDDTITYGGYSDHMVCEEDYIIRIPENLPLDATAPLLCAGTTVYSPMKYHGLDKPGMHIGVVGLGGLGHVAVKFAKAMGTKVTVISTSDRKRDEALTRLGADLFLVSRDPEQMKDAMGTMDGIIDTVSASHPVLPILDLLKYKGKLIMVGAPDKPLELPVLPLIFGKKMVVGSMVGGIKETQEMMDLAGKHNITADIELISADYVNTAMKRLEKADVRYRFVIDVANTLKPSP

SEQ ID NO: 332 - DNA, 651 bp, Brassica napus
  CDS (1)..(651)
atggcttcaactgcttcaaagttcataaaatgtgtgactgttggtgatggcgccgtaggtaaaacctgtatgctcatctgctacaccagcaacaaattccctactgactacataccaacagtttttgacaactttagtgcaaacgttgtagttgaaggcaccactgtgaacctaggcctatgggacactgctgggcaagaagactacaacagattaaggcctttaagttacagaggagcagatgttttcgtcctgtctttctccttggtcagccgagctagctacgagaatgtttataaaaagtggatccctgaactccaacactttgccccaggagttccattagtccttgttggtaccaaactagatctccgtgaagataataagcattatttggctgaccatcctggactatcccctgtaactactgcacagggagaggaattgcgtaagctaatcggtgcgacatattacattgaatgtagctcgaaaactcaacagaatgtgaaagcagtttttgattcagcgatcaaggaagtgatcaaaccggtggttaaacaaaaggagaagacgcagaaaacgaagaagcaaaagtctaatcatggctgtttatcaaacgttctgtgtgggaggatagtgactcggcattga

SEQ ID NO: 333 - protein, 216 aa, Brassica napus
MASTASKFIKCVTVGDGAVGKTCMLICYTSNKFPTDYIPTVFDNFSANVVVEGTTVNLGLWDTAGQEDYNRLRPLSYRGADVFVLSFSLVSRASYENVYKKWIPELQHFAPGVPLVLVGTKLDLREDNKHYLADHPGLSPVTTAQGEELRKLIGATYYIECSSKTQQNVKAVFDSAIKEVIKPVVKQKEKTQKTKKQKSNHGCLSNVLCGRIVTRH

SEQ ID NO: 334 - DNA, 1074 bp, Brassica napus
  CDS (1)..(1074)
atgggaaaggtgcctgcgacggaggcgttcggattggccgcgaaagacgaatccggagttctctcgcctttccgtttctcaagaagggagacgggagagaaggatgtgaggttaaaagtgttgttctgtggaatttgccacactgatgtatgtatggccagaaacgagtggggatttactacttaccctctcgtccccgggcatgagattgttggcgtggtgactgaagtcggagctaaagtgattaaattcaaagccggagacaaagtcggagttggttatatgctcagctcgtgccggtcatgtgacatctgcaccgatgaccaagagaaccactgtccaaaaatgattatgacgtccggaggaaagtactacgatgacaccatgacttatggtggttactctgaccacctggtttgtgaagaggattacatcatccgtattcctgaaaatctcccgttagacgctgccgcgccgctactctgcgctggggtcacggtttattcaccgttgaagtctcacggactcgacaagcccggaatccacattggtgtggtgggactaggcggtttaggtcacgtagcagtgaaatttgccaaggctatgggtactaaggttacggttattagttcgtcagatggtaagagagacgaggcgattaatcggcttggtgcggatctgttcttggtgagccgtgacccggaagagatgaaggatgcaatggggactatggatggtattattgatacagtatctgccactcatccgcttcttccgcttcttggtttgctaaaatataagggaaaatttattatggttggtgcacccgataaaccacttgaccttccagctttaccgctcatcttagggaagaagatggtggtgggaagtatgacaggagggataaaagagtctcaagagatggttgattttgccggtaaacacaacataacggcagatattgagcttatctctgcggattatgtcaacatggctatggaacggctagaaaagggggatgttagataccgttttgtgattgatgttgccaacacaatgaagcctactccttag

SEQ ID NO: 335 - protein, 357 aa, Brassica napus
MGKVPATEAFGLAAKDESGVLSPFRFSRRETGEKDVRLKVLFCGICHTDVCMARNEWGFTTYPLVPGHEIVGVVTEVGAKVIKFKAGDKVGVGYMLSSCRSCDICTDDQENHCPKMIMTSGGKYYDDTMTYGGYSDHLVCEEDYIIRIPENLPLDAAAPLLCAGVTVYSPLKSHGLDKPGIHIGVVGLGGLGHVAVKFAKAMGTKVTVISSSDGKRDEAINRLGADLFLVSRDPEEMKDAMGTMDGIIDTVSATHPLLPLLGLLKYKGKFIMVGAPDKPLDLPALPLILGKKMVVGSMTGGIKESQEMVDFAGKHNITADIELISADYVNMAMERLEKGDVRYRFVIDVANTMKPTP

SEQ ID NO: 336 - DNA, 1074 bp, Brassica napus
  CDS (1)..(1074)
atggggaaaatggaggtagagaggaaaacaacaggctgggctgcgagagacccttctgggttactctctccttacacttacactctcagagagacaggaccagaggatgttcacataagaatcatatgctgtggaatctgccacacagatctccatcaaaccaaaaacgatcttggcatgtcaaactaccccatggttcctgggcacgaggttgttggggaagtggtggaggtgggatcagatgtgagcaagttcaccgcaggggatatagttggagttggttgtctcgttggatgctgcggaggttgtagcccctgcgagagagatctggaacagtattgtcccaagaagatctggagctacaacgatgtttacatcgatggtcaaccaacacaaggcggtttcgctagagccaccgtcgttcaccaaaagtttgtggtgaagattccagaaggaatggctgttgagcaggcggcaccactactgtgtgccggtgtgacagtgtacagtccactggctcacttcggtctgaagcgaccaggcctaagaggaggtatactagggctaggtggagttggtcacatgggtgtgaaaatagccaaagcaatgggtcaccatgtgactgtcataagctcatcaaacaagaagaaagaagaggctttgaaagatcttggagcagatgattacgtgatcggatccgaccaatcgaagatgaacgaattggcggattcaatggattacataatcgacacggtccctgttcatcatgcacttgagccttacttgtctctgcttaggcttgatgggaaactcatactcatgggagtcataagcaatccattacaatttctcactcctatggttatgcttgggaggaaagtgataacggggagcttcattgggagcatgaaggaaacagaggagatgcttgagttctgtaaagaaaagggtttgagttcgatcatcgaagtagtgaagatggattatgtgaacactgcgtttgagagactcgagaagaacgatgtgcgttataggttcgtggttgatgtcgaaggaagcaaacttgaggcttga

SEQ ID NO: 337 - protein, 357 aa, Brassica napus
MGKMEVERKTTGWAARDPSGLLSPYTYTLRETGPEDVHIRIICCGICHTDLHQTKNDLGMSNYPMVPGHEVVGEVVEVGSDVSKFTAGDIVGVGCLVGCCGGCSPCERDLEQYCPKKIWSYNDVYIDGQPTQGGFARATVVHQKFVVKIPEGMAVEQAAPLLCAGVTVYSPLAHFGLKRPGLRGGILGLGGVGHMGVKIAKAMGHHVTVISSSNKKKEEALKDLGADDYVIGSDQSKMNELADSMDYIIDTVPVHHALEPYLSLLRLDGKLILMGVISNPLQFLTPMVMLGRKVITGSFIGSMKETEEMLEFCKEKGLSSIIEVVKMDYVNTAFERLEKNDVRYRFVVDVEGSKLEA

SEQ ID NO: 338 - DNA, 651 bp, Brassica napus
  CDS (1)..(651)
atggcttcaagtgcttcaaagttcatcaaatgtgtaactgttggtgatggtgccgttggtaaaacctgtatgctcatctgctataccagcaacaagttccctactgactatgtaccaacggtttttgacaactttagtgcaaacgttgtagttgaaggaactactgtgaacttagggctatgggatactgctggacaagaagactataacagattaaggcctttaagctacagaggagcagatgtcttcgtcttgtctttctcattggttagccgagctagctacgagaatgtttttaaaaagtggatccctgaactccaacactttgctccaggagttccattagttcttgtcggtaccaaattagatctccgtgaggataagcattatctggctgaccatcctggactatcccctgtaactactgcacagggagaggagttgcgtaagctcattggtgcaacatattacattgaatgtagctcaaaaactcaacagaatgtcaaagcagtttttgattcggcaatcaaggaagtgatcaaaccggtgcttaaacagaagggcaagaccaagaaaaagaagaagcaacagtcgaatcaccacgggtgtttatcaaacgttttgtgtgggaggatagtgacccggcattga

SEQ ID NO: 339 - protein, 216 aa, Brassica napus
MASSASKFIKCVTVGDGAVGKTCMLICYTSNKFPTDYVPTVFDNFSANVVVEGTTVNLGLWDTAGQEDYNRLRPLSYRGADVFVLSFSLVSRASYENVFKKWIPELQHFAPGVPLVLVGTKLDLREDKHYLADHPGLSPVTTAQGEELRKLIGATYYIECSSKTQQNVKAVFDSAIKEVIKPVLKQKGKTKKKKKQQSNHHGCLSNVLCGRIVTRH

SEQ ID NO: 340 - DNA, 348 bp, Brassica napus
  CDS (1)..(348)
atgtcagatcttgaagttcaagtccccactgcctttgatccgtttgctgatgcaaatgctgaggacgctggagctggagctggaacaaaggaatacgtgcacatacgtgttcagcagcgtaatggtagaaaaagcctgaccactgtccagggccttaagaaagagtatagctataccaagatcctcaaagacctcaagaaagagttttgctgcaatggcaccgtcgtccaagactctgagctaggacaggttattcagcttcaaggtgatcagaggaagaacgtgtccaccttccttgttcaggctggtcttgtgaagaaggataacatcaagatccatggtttttga

SEQ ID NO: 341 - protein, 115 aa, Brassica napus
MSDLEVQVPTAFDPFADANAEDAGAGAGTKEYVHIRVQQRNGRKSLTTVQGLKKEYSYTKILKDLKKEFCCNGTVVQDSELGQVIQLQGDQRKNVSTFLVQAGLVKKDNIKIHGF

SEQ ID NO: 342 - DNA, 1113 bp, Brassica napus
  CDS (1)..(1113)
atgagcctcaaagccggaatcgttggtcttccaaatgtcgggaagtccactctctttaacgccgtcgttgagaatggaaaggcgcaagcagctaatttccccttctgcacaattgagccgaatgttggaattgtggcagttcctgattctcgtcttcaagtgctctctaagctcaccaactctcagaaagtggtccctgcttccattgagttcgtggacattgctggtcttgtcaagggtgccagtcaaggcgagggattagggaacaagttcttatctcacatccgtgaagtggattcgatcctccaggtggtccgctgttttgaggacaacgacattgttcatgtcaatggcaaagttgatcccacctctgacattgatgtcatcaatctcgagcttatcttctgcgacttggatcagattggcaaaaggctcgacagacttaacaaaggcaagcctaaggattcccagtccaaagtcaaggaggaagctgaaaaatctgctctgcaaagaattcaggaggcccttctggacgggaaacctgcacgctctgttgcattgaatgacctcgagaaggacgccgtcaagcatctctgcttgcttaccatgaagcctatgatctacgtcgctaatgttgctgaaaccgatcttgccgaccctgacaagaattcttttgttcaacaagttaaggctctttcttcggatttgcagtctggtcatgtcgttgtttctgctcaggttgagtctgagttaaccgagcttcctcttgacgagcggactgaatatttgaactcgctaggtgtcagcgagagtggccttgggaaccttatcagggccacatacagtctgctaggtttgcagacctacttcacttctggtgaaaaggaaacaagagcctggacgatacacgcaggcatgactgcaccacaagccgctagtgtcattcactctgactttgagaagggttttattagagctgagactgttgcatatgaagattttgtctctgctggctctcttgccgcagcaagggataaaggacttttgagatcagagggtaaagagtacattgttaaagaaggagatgtgatgcttttccgcttcaacgtataa

SEQ ID NO: 343 - protein, 370 aa, Brassica napus
MSLKAGIVGLPNVGKSTLFNAVVENGKAQAANFPFCTIEPNVGIVAVPDSRLQVLSKLTNSQKVVPASIEFVDIAGLVKGASQGEGLGNKFLSHIREVDSILQVVRCFEDNDIVHVNGKVDPTSDIDVINLELIFCDLDQIGKRLDRLNKGKPKDSQSKVKEEAEKSALQRIQEALLDGKPARSVALNDLEKDAVKHLCLLTMKPMIYVANVAETDLADPDKNSFVQQVKALSSDLQSGHVVVSAQVESELTELPLDERTEYLNSLGVSESGLGNLIRATYSLLGLQTYFTSGEKETRAWTIHAGMTAPQAASVIHSDFEKGFIRAETVAYEDFVSAGSLAAARDKGLLRSEGKEYIVKEGDVMLFRFNV

SEQ ID NO: 344 - DNA, 588 bp, Brassica napus
  CDS (1)..(588)
atgagcgcttcgaggttcataaagtgtgtcaccgtcggcgatggtgccgtcggaaaaacctgtatgctgatctcttacacgagcaacaccttccctacggactatgtaccaactgttttcgataacttcagtgctaatgtggttgttgatgggaacactgtgaatcttggcttgtgggatacagctggtcaagaagactataacaggttaagaccattgagttaccgtggtgcggatgtcttcattcttgctttctctcttatcagcaaagctagctacgagaatatagctaagaagtggattcctgagctcaggcactatgcccctggtgttcctattatcctcgttggaacaaaactcgatcttcgagatgacaagcagttcttcatagaccaccctggtgcagtgccgattagtactaaccagggagaggaactaaagaaactgatagggtctccggcttacattgaatgcagttcaaagacgcagcagaacgtgaaggcagtctttgacgcagccataaaagtagtgcttcagccaccaaagcaaaagaagaagaaaaagaagaatggttgtgttttcttgtga

SEQ ID NO: 345 - protein, 195 aa, Brassica napus
MSASRFIKCVTVGDGAVGKTCMLISYTSNTFPTDYVPTVFDNFSANVVVDGNTVNLGLWDTAGQEDYNRLRPLSYRGADVFILAFSLISKASYENIAKKWIPELRHYAPGVPIILVGTKLDLRDDKQFFIDHPGAVPISTNQGEELKKLIGSPAYIECSSKTQQNVKAVFDAAIKVVLQPPKQKKKKKKNGCVFL

SEQ ID NO: 346 - DNA, 495 bp, Brassica napus
  CDS (1)..(495)
atgccggcgggtcacggagtgagggcgagaaccagggatctgttcgctagagggttcaggaagaagggtgttatcccactttccacctaccttaggaccttcaaagtcggtgattacgtggatgtgaaggtaaatggagccatccacaagggtatgcctcacaagttctaccatggtcgtactggtcgtgtctggaacgttactaagcgagctgttggtgtcgaagtcaacaagcagattggtaacagaatcattaggaagaggttgcatgttcgtgtggagcacgtgcagcagtcaaggtgtgctgaggagtttaaactaaggaagaagaataacgatgtgctcaaggctgcagccaaagccagaggggagacaatcagcaccaagagacagcctaaaggtcccaagcctggtttcatggtcgagggtatgacattggagactgtcactcccatcccttacgatgttgtcaacgatctcaagggtggctactaa

SEQ ID NO: 347 - protein, 164 aa, Brassica napus
MPAGHGVRARTRDLFARGFRKKGVIPLSTYLRTFKVGDYVDVKVNGAIHKGMPHKFYHGRTGRVWNVTKRAVGVEVNKQIGNRIIRKRLHVRVEHVQQSRCAEEFKLRKKNNDVLKAAAKARGETISTKRQPKGPKPGFMVEGMTLETVTPIPYDVVNDLKGGY

SEQ ID NO: 348 - DNA, 411 bp, Brassica napus
  CDS (1)..(411)
atggctcgtaccaagcaaaccgcaaggaaatccaccggaggcaaagccccaagaaagcagctcgcaacgaaagcagccagaaaatccgctccggccaccggcggcgtgaagaagccacacagattccgtccaggaacggtggccttgagagagatcaggaagtaccagaagagcactgagcttctgatccgtaagcttcctttccagcgtctggttcgtgagatcgctcaggatttcaagacggatctgaggttccagagcagcgccgtcgcggctctacaggaagcagccgaggcttaccttgttgggttatttgaggacaccaatctctgtgcgattcatgcgaagagagtcactatcatgcctaaggatatccagctcgctaggagaatccgtggtgaaagagcttga

SEQ ID NO: 349 - protein, 136 aa, Brassica napus; identical to SEQ ID NO: 306

SEQ ID NO: 350 - DNA, 492 bp, Brassica napus
  CDS (1)..(492)
atggcggatcagctcaccgacgatcagatttttgggttcaaggaagcattcagttttttcgacaaggatggtgacggttgcattcccacgagggagtttggccccgtgatgcgttccctgggtcaaaccccgacagaagctgagcttcaggacatgatcaacgaagttgacgcagatggtaacggacccatcgattttcctgagttcttgacccttatggctaggaaaatgaaggacccggactttgggggggaactcaaggaagcgttcagagtttttgataaagcccagaacggtttcatttctgctgctgagttgagacatgtgatgacgaatctcggcgagaagctaactgatgaggaagttgatgagatgattaaggaagctgatgttgatggtgatggtcagattaactatgaagagttcgtcaaggttatgatggccaagtggggccacaacctacttgttacttcccctctttttattatgtaa

SEQ ID NO: 351 - protein, 163 aa, Brassica napus
MADQLTDDQIFGFKEAFSFFDKDGDGCIPTREFGPVMRSLGQTPTEAELQDMINEVDADGNGPIDFPEFLTLMARKMKDPDFGGELKEAFRVFDKAQNGFISAAELRHVMTNLGEKLTDEEVDEMIKEADVDGDGQINYEEFVKVMMAKWGHNLLVTSPLFIM

SEQ ID NO: 352 - DNA, 597 bp, Brassica napus
  CDS (1)..(597)
atgagtgcttcgaggtttatcaagtgtgtcaccgtcggcgacggcgctgtcggaaagacttgtctgctcatctcctacactagcaacactttccccacggactatgtgccaactgtgtttgataatttcagcgcgaatgtgattgtggatgggaacactatcaacttgggattgtgggatactgcagggcaagaggactacaatagactaagaccattgagctatcgcggcgcagatgtcttcttactcgctttctcccttgtcagcaaagctagctatgaaaatgtttctaaaaagtgggtacctgaactgagacattatgctcctggtgttccaatcatcctcgtcggaaccaagcttgatcttcgagatgacaagcaattctttgttgagcaccctggtgctgtgcctatctctactgctcagggtgaagaactgaagaaggtgattggggcacctgcttatattgaatgcagtgcaaaaacacaacagaatgtaaaagcggtgtttgatgcggctatcaaggtagttctccaaccacccaaaaacaagaagaggaagaagagaaagtctcagaaagcttgttctatattgtga

SEQ ID NO: 353 - protein, 198 aa, Brassica napus
MSASRFIKCVTVGDGAVGKTCLLISYTSNTFPTDYVPTVFDNFSANVIVDGNTINLGLWDTAGQEDYNRLRPLSYRGADVFLLAFSLVSKASYENVSKKWVPELRHYAPGVPIILVGTKLDLRDDKQFFVEHPGAVPISTAQGEELKKVIGAPAYIECSAKTQQNVKAVFDAAIKVVLQPPKNKKRKKRKSQKACSIL

SEQ ID NO: 354 - DNA, 450 bp, Brassica napus
  CDS (1)..(450)
atggcggaccagctaaccgatgaccagatctccgagttcaaggaagccttcagcctattcgacaaggacggagatggctgcatcaccacaaaggagctcgggacggtgatgagatcacttgggcaaaaccctacagaagctgagctccaagacatgatcaacgaggttgacgcagacgggaatggaacgatagatttcccggagtttctgaacctaatggcccgcaagatgaaggacactgattcagaggaagagcttaaagaagccttcagggtttttgacaaggaccagaacggtttcatctccgcggctgagctccgccacgtgatgacaaatcttggggagaagctaactgacgaagaagtggatgagatgatccgagaggctgacgtggatggtgatggtcagatcaactatgatgagttcgttaaagttatgatggcaaagtga

SEQ ID NO: 355 - protein, 149 aa, Brassica napus
MADQLTDDQISEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 356 - DNA, 483 bp, Brassica napus
  CDS (1)..(483)
atgatacattttgtgcttctcgttagccgccaaggaaaagtcaggctcaccaaatggtactcgccttatacgcagaaggaaagatctaaggttatacgtgagctcagtggagtgattctgaaccgaggtcccaagctctgcaactttatcgagtggagaggatacaaagtcgtctacaaaagatacgcgagcctctacttctgtatgtgcattgatgcggaggataacgagttggaggtccttgagatcattcatcactacgttgagatcctcgaccgctatttcggaagtgtgtgtgagctcgatttgatttttcacttccacaaggcgtattacatattggacgagcttttgattgccggtgagctccaagagtcaagcaagaaaacagttgccaggattatctctgctcaggatcaaatggtggaagctgcaaaagaggaggctggttccattagctacatcatcgctcagactacttaa

SEQ ID NO: 357 - protein, 160 aa, Brassica napus
MIHFVLLVSRQGKVRLTKWYSPYTQKERSKVIRELSGVILNRGPKLCNFIEWRGYKVVYKRYASLYFCMCIDAEDNELEVLEIIHHYVEILDRYFGSVCELDLIFHFHKAYYILDELLIAGELQESSKKTVARIISAQDQMVEAAKEEAGSISYIIAQTT

SEQ ID NO: 358 - DNA, 1083 bp, Brassica napus
  CDS (1)..(1083)
atggcgaaatctccagagacagagcatccgaacaaagcctttggttgggctgccaaagacaaatctggtgtactctctcctttccatttctccagaagagacaatggtgacaatgatgtgacagtgaaaatcttgtactgtggagtgtgccacactgatttacataccatcaaaaacgactggggtttctcctattatcctgtagttcccgggcatgaaatagttggaatagctacaaaagttggcaaaaacgtgactaaattcagagaaggagaccgtgttggagtaggagtgatcactggttcttgccagtcttgcgaatcttgtaaccaagatcttgaaaactactgtccccaaatgtctttcacctacaactccataggatccgatggaaccaagacctacggtggatattcggagtccattgtggtcgatcaacgttttgtcttacagtttcccgagggattgcctagcgattcgggtgcccccttgctgtgtgctggtatcactgtgtatagtccaatgaagtactatggtatgaccgagccagggaagcatttgggcgtggctggacttggtgggcttggtcatgttgctgtcaagattggtaaagcctttggtttgaaagttactgtgattagttcttctcctagtaaagaagacgaagctattaatcgacttggtgctgattcgtttcttgtctcatctgatcctcagaagatgaaggctgcaattggaactatggactatattatcgatacggtatcagcagtacatgctctgtttccattgcttggtttactcaaagtcaatggaaagcttgtcacgttaggcttacctgagaagcctcttgagctaccaatcttccctcttgttctcggaagaaaaatggtgggaggaagtgacattggagggatgaaggagacacaagagatgcttgagttctgcgctaagcataacataacggcagatattgagctgatcaagatggatgagattaacactgcgatggagaggcttgctaagtctgatgttaggtacaggttcgtgatcgacgtggctaactccttgagccctccatga

SEQ ID NO: 359 - protein, 360 aa, Brassica napus
MAKSPETEHPNKAFGWAAKDKSGVLSPFHFSRRDNGDNDVTVKILYCGVCHTDLHTIKNDWGFSYYPVVPGHEIVGIATKVGKNVTKFREGDRVGVGVITGSCQSCESCNQDLENYCPQMSFTYNSIGSDGTKTYGGYSESIVVDQRFVLQFPEGLPSDSGAPLLCAGITVYSPMKYYGMTEPGKHLGVAGLGGLGHVAVKIGKAFGLKVTVISSSPSKEDEAINRLGADSFLVSSDPQKMKAAIGTMDYIIDTVSAVHALFPLLGLLKVNGKLVTLGLPEKPLELPIFPLVLGRKMVGGSDIGGMKETQEMLEFCAKHNITADIELIKMDEINTAMERLAKSDVRYRFVIDVANSLSPP

SEQ ID NO: 360 - DNA, 366 bp, Brassica napus
  CDS (1)..(366)
atgatccgattcatattattgcagaacagacaagggaagactcgtcttgccaagtactatgtccctctcgaagaatcggagaaacacaaagtcgaatacgaggttcataggttagtggtgaaccgcgatgccaagttcaccaatttcgttgagtttagaacacacaaggtgatatacaggcgttacgctggactgtttttctccgtgtgcgtggacataacggacaatgagttggcttaccttgagtgcatccatttgtttgtggagattttggatcacttcttcagcaatgtctgtgagcttgatttggtcttcaacttccacaagacttccccatatatgtttgattttaacaggtgtacttga

SEQ ID NO: 361 - protein, 121 aa, Brassica napus
MIRFILLQNRQGKTRLAKYYVPLEESEKHKVEYEVHRLVVNRDAKFTNFVEFRTHKVIYRRYAGLFFSVCVDITDNELAYLECIHLFVEILDHFFSNVCELDLVFNFHKTSPYMFDFNRCT

SEQ ID NO: 362 - DNA, 831 bp, Brassica napus
  CDS (1)..(831)
atggcctccggtttaatcggaagattcgttagaaccaatccgtcgcgattaaccaccgcggcgaggctaatcccgtcgcgatgcacagcttcctcaacggataacggcggcggcggcggcggcaaagcatcgaacctgaagacgttccagatctaccgatggaaccccgacaaccccagcaagcccgagctccaagactaccagatcgacctcaaggactgtggcccgatggtcctcgacgccctaatcaagatcaagaacgagatggatccctccctcaccttccgccgctcgtgccgagaagggatctgcggctcgtgcgcgatgaacatcgacgggtgcaacgggctcgcgtgcttgacgaagatcgaggagggatccaaggagacgacgatcactcccttgccgcatatgttcgtgatcaaggatctggtggtggacatgacgaatttttataatcagtataagagtatcgagccgtggctgaagaggaagagtccggcgtctgagcctgggaaggagattctgcagagtaagaaggatagggcgaagcttgatgggatgtatgagtgtattctttgtgcttgttgtagcacgtcgtgtcctagttattggtggaaccccgagtcttatcttggccctgctgctttgctacatgccaacaggtggataagcgacagtcgtgatgagtacactaaggagagacttgaggctattgacgacgagttcaagctttaccgttgccatacaatcttgaactgcgcccgtgcctgtccaaagggtttgaacccaggcaaacagatcgcgcatatcaagcaacttcagcgctga

SEQ ID NO: 363 - protein, 276 aa, Brassica napus
MASGLIGRFVRTNPSRLTTAARLIPSRCTASSTDNGGGGGGKASNLKTFQIYRWNPDNPSKPELQDYQIDLKDCGPMVLDALIKIKNEMDPSLTFRRSCREGICGSCAMNIDGCNGLACLTKIEEGSKETTITPLPHMFVIKDLVVDMTNFYNQYKSIEPWLKRKSPASEPGKEILQSKKDRAKLDGMYECILCACCSTSCPSYWWNPESYLGPAALLHANRWISDSRDEYTKERLEAIDDEFKLYRCHTILNCARACPKGLNPGKQIAHIKQLQR

SEQ ID NO: 364 - DNA, 951 bp, Brassica napus
  CDS (1)..(951)
atgttgggggatgcttttcttcaccaattgccacatgcttttggtggtggtcactctcattcgcatgatcaccatgagagtcatgaccatcatgatcattctcactctcattcggattcgccttcacattcacattctatacaagatctgtctgttggactgtctgttcttgctgggattgtggtcttccttcttgtggagaaattggtgcggtacgtcgaagaaaactcgtctggatccaatgcttggggtcaccatcaccaccaccaccatgcaggaggcagtaagaaactgaaggatgaggacgatcataacaacgcggacaaacagtgtccctctgatgcaactgaaaattcatcagaaaaagtctctaaagataaatctctccgtaagagaaagacttctgctattgatggtgtggataaatcaaactcaggctcagaaactatctccaatggaaaattggacaaacctgaacaggcggagaagaactcaagcctagtatttggttacctcaacttgttctctgatggtgttcacaattttactgatggaatggcgttaggaagtgcgtttctcatctacggatcagttggtggatggtcaagaaccatgttcttgcttgcgcacgagcttccccaagagataggtgattttgggattctagtgaggtcaggcttcactgtaacaaaggcactcttcttcaacttcctctctgcactcgttgcacttgcaggaacttcattggttctggtctggggagatgaaccgggacagtcatcattgattgagggattcacagcgggaggattcatatacatagcggttgcaggtgttcttgcggagatgaacaacaactcgggaaaatcgacagttaaaaacagtgtgtgccatttgatatcgttgatgcttggcatgagtgttgctcttgtcatctctcttcttgaatga

SEQ ID NO: 365 - protein, 316 aa, Brassica napus
MLGDAFLHQLPHAFGGGHSHSHDHHESHDHHDHSHSHSDSPSHSHSIQDLSVGLSVLAGIVVFLLVEKLVRYVEENSSGSNAWGHHHHHHHAGGSKKLKDEDDHNNADKQCPSDATENSSEKVSKDKSLRKRKTSAIDGVDKSNSGSETISNGKLDKPEQAEKNSSLVFGYLNLFSDGVHNFTDGMALGSAFLIYGSVGGWSRTMFLLAHELPQEIGDFGILVRSGFTVTKALFFNFLSALVALAGTSLVLVWGDEPGQSSLIEGFTAGGFIYIAVAGVLAEMNNNSGKSTVKNSVCHLISLMLGMSVALVISLLE

SEQ ID NO: 366 - DNA, 411 bp, Brassica napus
  CDS (1)..(411)
atggctcgtacgaagcagactgcgaggaaatcgacaggaggaaaagctccgaggaagcaactcgccaccaaggctgcgaggaaatctgcaccgaccaccggaggagtcaagaagcctcaccgttaccgtcccggaaccgtcgctctccgtgagattcgtaagtaccagaagagcactgagttgctgatccgtaaacttcccttccagcgtcttgttcgtgaaatcgctcaggatttcaagacggatctgagattccagagccacgcagtgttggctctccaggaagctgcggaggcgtatttggtgggtttgttcgaagacacgaatctctgtgccattcacgccaagagagtcaccatcatgcccaaagacattcaattggctaggcgcattcgtggagagcgtgcttag

SEQ ID NO: 367 - protein, 136 aa, Brassica napus; identical to SEQ ID NO: 298

SEQ ID NO: 368 - DNA, 411 bp, Brassica napus
  CDS (1)..(411)
atggctcgtaccaagcaaaccgctaggaaatccaccggaggcaaagcaccaaggaagcagctcgcgacgaaagccgcaagaaaatccgctccggccaccggcggagtgaagaagccgcacagattccgtcccggaacggtggcgttgagggagatcaggaagtaccagaagagcacggagcttctgatccgcaagctccccttccagcgtcttgtccgtgagatcgctcaggatttcaaaaccgatctgaggttccagagcagcgccgtcgcagctcttcaagaagcagccgaagcttaccttgttggtttgttcgaagacacgaatctctgcgcgattcacgcgaagagagtaacaatcatgccaaaggacatccagctggcaagaagaatcagaggcgaaagagcttga

SEQ ID NO: 369 - protein, 136 aa, Brassica napus; identical to SEQ ID NO: 306

SEQ ID NO: 370 - DNA, 1185 bp, Brassica napus
  CDS (1)..(1185)
atgcctccgaaagcaaaagcaaaggatgcaggtcccgtggagaggcctattcttggccgcttctcgtctcacctcaagatcggaatcgtggggctgccaaacgtggggaagtctacacttttcaacactcttacgaagctttcgattccagctgagaacttccccttctgtaccattgagcctaacgaggcgcgtgtgaatatccccgacgagaggttcgattggctttgccagttatacaagcctaagagtgagattccagcgttcttggaaatacacgacattgctgggcttgttagaggcgctcatgaaggacagggacttgggaacaacttcttgtctcacattcgtgctgttgatggaatcttccatgttttacgtgcgtttgaagatcctgatattattcatgttgatgacattgtggatcctgttagagatttggagaccattactgaagagttgcgacttaaggatattgaattcattaaaaagaagattgaagatgtcgagaagagcatgaagaggagcaatgacaaggccctcaaagttgaacttgagctcttgctaaaggtaaaagcttggctggaagaaggaaaggatgtccgttttggagactggaaagcagctgatatcgagattttgaacactttccagttgctttccgctaagcccgttgtttacttgattaacatgaatgagagagactaccagaggaagaaaaacaagttcttgcccaagattcatgcttgggttcaagagcacggtggtgatactatgattcctttcagtggtgtttttgaaaggagtctcgctgatatgctccccgacgaagcagcaaagtattgtgaggagaacaaactgcaaagtgctcttccgaggatcatcaaaacgggattttcagccattaatctcatatatttctttactgcaggacctgatgaggtaaagtgctggcaaataagacgtcagtcaaaggctcctcaagctgcaggcgccattcatactgattttgagagagggtttatttgtgctgaggtcatgaaatttgaggatctcaaggaacttggcaatgaaaccgcagtcaagggcgcaggaaaatacagacaggaggggaaaacatatgttgttcaggatggagatatcattttcttcaagttcaacgtttctggtggtgggaagaaatga

SEQ ID NO: 371 - protein, 394 aa, Brassica napus
MPPKAKAKDAGPVERPILGRFSSHLKIGIVGLPNVGKSTLFNTLTKLSIPAENFPFCTIEPNEARVNIPDERFDWLCQLYKPKSEIPAFLEIHDIAGLVRGAHEGQGLGNNFLSHIRAVDGIFHVLRAFEDPDIIHVDDIVDPVRDLETITEELRLKDIEFIKKKIEDVEKSMKRSNDKALKVELELLLKVKAWLEEGKDVRFGDWKAADIEILNTFQLLSAKPVVYLINMNERDYQRKKNKFLPKIHAWVQEHGGDTMIPFSGVFERSLADMLPDEAAKYCEENKLQSALPRIIKTGFSAINLIYFFTAGPDEVKCWQIRRQSKAPQAAGAIHTDFERGFICAEVMKFEDLKELGNETAVKGAGKYRQEGKTYVVQDGDIIFFKFNVSGGGKK

SEQ ID NO: 372 - DNA, 825 bp, Brassica napus
  CDS (1)..(825)
atgtctcagtcaacagtggatgttccgccgaagggtgggttcagcttcgatctgtgtaagcgaaacgatatgcttatacaaaagggtcttaaagctccctcctttttgaagaccggtaccaccatcgtcggtttgatcttcaaggatggtgtgatactaggtgcggatacccgagcaactgaagggcctattgttgctgataagaactgtgagaaaattcactacatggctcctaacatttattgctgtggtgctggaacggctgctgacactgaagcagtcactgatatggtcagctcacagctgcggctgcatcgttaccagactggccgagactctcgggttatcactgctttgacccttctcaaaaaacaccttttcagctatcaaggtcatgtctcagctgctctcgtccttggtggagttgatatcacagggcctcatctgcatactatatacccacacggttcaacggacactctgccattcgctacaatgggttctggttctcttgctgctatgtctgtctttgaggcaaagtataaagaaggtctaactagggatgaaggaattaagctggtcgctgaggccatatgctcgggtatattcaacgacctgggtagtggtagcaacgtggacatctgcgtaatcactaagggaaacaaggagtatctgaggaactacatggaaccaaacccaagaacctatgtcagcagcaaaggctattcgttcaccaagaaaaccgaggttcttcggaccaaaatcaccccattgatggagcgagttgaaattacagaagtgactggtgaagctatggaagagtaa

SEQ ID NO: 373 - protein, 274 aa, Brassica napus
MSQSTVDVPPKGGFSFDLCKRNDMLIQKGLKAPSFLKTGTTIVGLIFKDGVILGADTRATEGPIVADKNCEKIHYMAPNIYCCGAGTAADTEAVTDMVSSQLRLHRYQTGRDSRVITALTLLKKHLFSYQGHVSAALVLGGVDITGPHLHTIYPHGSTDTLPFATMGSGSLAAMSVFEAKYKEGLTRDEGIKLVAEAICSGIFNDLGSGSNVDICVITKGNKEYLRNYMEPNPRTYVSSKGYSFTKKTEVLRTKITPLMERVEITEVTGEAMEE

SEQ ID NO: 374 - DNA, 786 bp, Brassica napus
  CDS (1)..(786)
atggctgtcgggaagaacaagaggatctcaaaaggtcgtaaaggagggaagaagaagattgttgatccattctccaagaaggattggtatgacatcaaggctccctctatcttcaaacagagaaatgtcggcaagacacttgtttctagaactcagggtaccaagattgcctctgagggtttgaaacacagagttttcgaggtttctcttgctgatctccaaggtgatgaggaccactcttacaggaagatccgtctcagagctgaagatgttcagggcaggaatgtcttgacccagttctggggtatggatttcaccaccgacaagctgaggtcgttggtgaagaagtggcagactttgattgaagctcatgtcgatgtgaagaccactgacagctacaccttgaggttgttctgcattgctttcaccaagaggcgtgctaaccaggtcaagcgtacttgctatgctcagtccagccaaatccgccagatccgcaggaagatgagtgaaatcatggtgaaggaggcttcatcctgtgaccttaaggagcttgtggccaagttcatccctgagtccattggaagagatattgagaaggcgactcagaacatctacccgttgcagaatgtgttcatccgtaaggtcaagatcctcaaggctcccaagtttgaccttggcaagctcatggaggttcatggtgactacacagcagaggatgttggtgtgaaagtagacaggccagatgaaacagtggctgaggaaccaaccgaaatcatcggagcttag

SEQ ID NO: 375 - protein, 261 aa, Brassica napus
MAVGKNKRISKGRKGGKKKIVDPFSKKDWYDIKAPSIFKQRNVGKTLVSRTQGTKIASEGLKHRVFEVSLADLQGDEDHSYRKIRLRAEDVQGRNVLTQFWGMDFTTDKLRSLVKKWQTLIEAHVDVKTTDSYTLRLFCIAFTKRRANQVKRTCYAQSSQIRQIRRKMSEIMVKEASSCDLKELVAKFIPESIGRDIEKATQNIYPLQNVFIRKVKILKAPKFDLGKLMEVHGDYTAEDVGVKVDRPDETVAEEPTEIIGA

SEQ ID NO: 376 - DNA, 411 bp, Brassica napus
  CDS (1)..(411)
atggctcgcaccaagcaaaccgccaggaaatcaaccggaggcaaagccccaagaaagcagctcgcgaccaaagcggcgaggaaatcagctccggccaccggaggagtgaagaagccgcacaggttccgtccaggaacggtggcgctgagggagatcaggaagtaccagaagagcaccgagcttctgatccgcaagctccccttccagcgtctggtccgtgagatcgctcaggatttcaagacggatctgaggttccagagcagcgccgtcgccgctttgcaagaggctgcggaggcttacctcgttgggctgttcgaagacacgaatctctgcgcgattcacgccaagagggttacgatcatgccgaaggatatccagctcgcgaggagaatccgtggcgaaagagcttga

SEQ ID NO: 377 - protein, 136 aa, Brassica napus; identical to SEQ ID NO: 306

SEQ ID NO: 378 - DNA, 1062 bp, Brassica napus
  CDS (1)..(1062)
atgggaaaggaggcatttggattggccgcgaaagacaattctggagttctctcgcctttccatttctctagaagggagacaggagagaaggatgttaggttcaaagttttgttctgtggaatctgtcactctgatttgcatatgatcaagaatgagtggggaatatctacttaccctctcgtccccgggcatgagattgttggtgtggtgactgaagtgggaagcaaagtgactaaattcaaaactggagacaaagtcggagtaggttgcatggttggctcgtgcggatcatgtgatagctgcaccgaaggtctcgagaactactgtccaaaatcgatccaaacgtacggattcaagtattacgacgacacaataacctacggtggttactccgacaacatggtttgcgacgaaggtttcatcatccgtatgcccgaaaatctcccattggacgctgctgctccgctactatgcgcggggatcacggtctactccccgctgaaacatcacgggctcgacaagcctggcatgcacattggtgtggttggactaggcggtttgggtcatgtggcggtgaaatttgctaaggctatgggtcttaaggttacggttattagtacttcggatagtaagagagatgaagcgattaataggcttggtgcggacgcgttcgtggtgagccgtgaccaaaaacagattaaggatgcaatgaggacattggatggtattattaataccgtatctgcgactcattcccttcttcctttgctcggtttgctaaagcctaagggaaaacttgttatggttggtgcaccagaaaagccactcgagctcccggtcatgcctctcatcttcgagaggaagatggtaatgggaagtatgataggagggataaaggagactcaagagatggtggatatggcaggaaaacacaacatcactgctgatattgagcttatctctgcggactatgtcaacactgccatggaacggctcgagaaggccgacgttagataccgttttgtgattgatgttgccaacacattgaagcctactccttaa

SEQ ID NO: 379 - protein, 353 aa, Brassica napus
MGKEAFGLAAKDNSGVLSPFHFSRRETGEKDVRFKVLFCGICHSDLHMIKNEWGISTYPLVPGHEIVGVVTEVGSKVTKFKTGDKVGVGCMVGSCGSCDSCTEGLENYCPKSIQTYGFKYYDDTITYGGYSDNMVCDEGFIIRMPENLPLDAAAPLLCAGITVYSPLKHHGLDKPGMHIGVVGLGGLGHVAVKFAKAMGLKVTVISTSDSKRDEAINRLGADAFVVSRDQKQIKDAMRTLDGIINTVSATHSLLPLLGLLKPKGKLVMVGAPEKPLELPVMPLIFERKMVMGSMIGGIKETQEMVDMAGKHNITADIELISADYVNTAMERLEKADVRYRFVIDVANTLKPTP

SEQ ID NO: 380 - DNA, 852 bp, Brassica napus
  CDS (1)..(852)
atggcgtccggtttaatcggaagattagtcagaaccaaaccggcgagattaaccacggcggctaggttaatcccgtcgcgatgcacatcctcctcaacggaatcaaaaccttcgtccggcggcgttggcggaggcggagggagaggatcgaacctgaagacgttccagatctaccggtggaatcccgatagccccgggaagccggagctccaagactaccagatcgatctcaaggactgcggcccgatggtactagacgctctgatcaagatcaaaaacgagatggatccgtcgctcaccttccgccgctcctgccgcgaagggatctgcggctcgtgcgcgatgaacattgacgggtgcaacggcctcgcgtgtttgacgaagatcgaaggagacggggctaaggagacgacgatcactcccttgccgcatatgtttgtgatcaaggatctggtggtggacatgacgaacttttataatcagtataagagtatcgagccgtggttgaagaggaagagtccgggggatgaggctgggaaggagattctgcagagtaagaaggatagggcgaagcttgatgggatgtatgagtgtatcttgtgtgcttgttgtagcacgtcgtgtcctagttactggtggaaccctgagttttaccttggccccgccgctttgctacacgcaaacaggtggataagcgacagtcgggatgagtacacaaaggaaagactcgaggctattgacgacgagttcaagctttaccgttgccatacaatcttgaactgtgctcgtgcctgtccaaagggtttgaaccctggcaaacagatcgcacacatcaagcaacttcagcgttga

SEQ ID NO: 381 - protein, 283 aa, Brassica napus
MASGLIGRLVRTKPARLTTAARLIPSRCTSSSTESKPSSGGVGGGGGRGSNLKTFQIYRWNPDSPGKPELQDYQIDLKDCGPMVLDALIKIKNEMDPSLTFRRSCREGICGSCAMNIDGCNGLACLTKIEGDGAKETTITPLPHMFVIKDLVVDMTNFYNQYKSIEPWLKRKSPGDEAGKEILQSKKDRAKLDGMYECILCACCSTSCPSYWWNPEFYLGPAALLHANRWISDSRDEYTKERLEAIDDEFKLYRCHTILNCARACPKGLNPGKQIAHIKQLQR

SEQ ID NO: 382 - DNA, 411 bp, Brassica napus
  CDS (1)..(411)
atggctcgtaccaagcaaacagctagaaaatccaccggaggcaaggccccaaggaagcagctcgcaacaaaagcggcaagaaaatctgctccggccaccggcggagtgaagaagccgcacagattccgtcccggaacagtcgccttgagagagatcagaaagtaccaaaaaagcacagagcttctgatccgcaagctccccttccagcgtctagtccgtgagatcgctcaggatttcaaaaccgatctgaggttccagagcagcgccgtcgcagctcttcaagaagcagctgaagcttaccttgttgggttgttcgaagacacgaatctctgcgcgattcacgcgaagagagtaacaatcatgccaaaggatatccagctggcaagaagaatcagaggcgaaagagcttga

SEQ ID NO: 383 - protein, 136 aa, Brassica napus; identical to SEQ ID NO: 306

SEQ ID NO: 384 - DNA, 192 bp, Brassica napus
  CDS (1)..(192)
atgatgaagcgtctgatcccaacgttcaaccgcatcctggtgcagagagtcatccagcctgctaaaaccgagagcggcatcctcctccctgagaaagcctccaagctgaactcgggcaaggtgatagcagttggacctggatcaagggataaggacgggaaatttgattccggtctctgtcaaggaaggtga

SEQ ID NO: 385 - protein, 63 aa, Brassica napus
MMKRLIPTFNRILVQRVIQPAKTESGILLPEKASKLNSGKVIAVGPGSRDKDGKFDSGLCQGR

SEQ ID NO: 386 - DNA, 426 bp, Brassica napus
  CDS (1)..(426)
atgaaaggtggtgaaaccaaagctcaatcgaagagcaccgatgaaagattgaaaacgagaggaaagaaagctggaaagaaagcagccaaggatcctaacaagcctaagaggcctccaagtgccttcttcgtcttcctggagggattccgtaaggagttcaatctagctaaccctgacaacaaatccgtcggagctgttggtaaagctgctggagctaaatggaaatcaatgactgatgaagacaaagctccttatgtggccaaggcagagagcaagaagactgaatataccaagactatgcaaaagtacaacatgaaactggctaatggaactagcacagctggagatgatgactctgacaagtccaagtccgaagtcaacgatgaagcagaaggtggaagtgaagaggaggaagatgatgattag

SEQ ID NO: 387 - protein, 141 aa, Brassica napus
MKGGETKAQSKSTDERLKTRGKKAGKKAAKDPNKPKRPPSAFFVFLEGFRKEFNLANPDNKSVGAVGKAAGAKWKSMTDEDKAPYVAKAESKKTEYTKTMQKYNMKLANGTSTAGDDDSDKSKSEVNDEAEGGSEEEEDDD

SEQ ID NO: 388 - DNA, 804 bp, Brassica napus
  CDS (1)..(804)
atgtaccgccgaagggtgggttcagcttcgatctgtgcaagagaaacgatatgcttatccaaaagggtcttaaagctccctccttttttgaagaccggtactaccatcgtcggtttgatcttcaaggatggtgttatactaggcgctgatacacgagcaactgagggacctatcgttgctgataagaactgtgagaagattcactacatggcacctaacatttactgctgtggtgctggaaccgctgctgacactgaagctgtcactgatatggtcagctcacagctgaggttgcatcgttaccagactgggcgagactctcgggtcatcactgctttgacccttctcaaaaagcaccttttcagctatcaaggtcatgtctcagctgctcttgtccttggtggagtcgatatcaccgggcctcatctgcataccatatacccacacggttcaactgacactctaccattcgctacaatgggttctggttctcttgctgctatgtctgtctttgaggcaaagtacaaagaaggtctaactagggacgaaggaatcaagctggtggctgaagccatatgctcgggaatattcaacgacctgggtagtggtagcaacgtggacatctgcgtgatcacaaaggggcacaaggaatatctcaggaactacatggaaccaaacccaagaacctatgtcagcagcaaaggctattcattcaccaagaaaaccgaggttcttcgcacgaaaatcaccccattgatggagcgagttgagattacagaagtgggtgaagctatggaagaatga

SEQ ID NO: 389 - protein, 267 aa, Brassica napus
MYRRRVGSASICARETICLSKRVLKLPPFLKTGTTIVGLIFKDGVILGADTRATEGPIVADKNCEKIHYMAPNIYCCGAGTAADTEAVTDMVSSQLRLHRYQTGRDSRVITALTLLKKHLFSYQGHVSAALVLGGVDITGPHLHTIYPHGSTDTLPFATMGSGSLAAMSVFEAKYKEGLTRDEGIKLVAEAICSGIFNDLGSGSNVDICVITKGHKEYLRNYMEPNPRTYVSSKGYSFTKKTEVLRTKITPLMERVEITEVGEAMEE

SEQ ID NO: 390 - DNA, 1593 bp, Brassica napus
  CDS (1)..(1593)
atggacgatccgacgaccccttctccatacgatcttctctttgaaggtctctggctcatcccaattcgtcactatctctacgctctcatcctcatctggaccgtattcttctacaatttcgtggagttccatttccttggtgatgcggttcttcagtatttcagaggtcgagtgaatctcatctacaacccagattctcctatttaccacggtgttgtctctcgctgccggactcttcacggccggtatgtggcgacaccgtggttagcgagtcctcatcttcagacttgtttccttaatttccatggattgcctcccgttttcacctacacaagaaagctctttcgtgcttctgatggtggaaccattgctctcgattggcttaccaactcccatgttgatgatgcagatcctcacaatcagaatgaaatcagtaaagaagacacaactcctattgctgttgttattccagggctaactagtgattcttcttctgcatatctaaagcaccttgcctataacactgcaaaatccggttggaatgttgttataagcaaccatagaggactgggtggtatttctgtcacttccgattgcttctataatgctggatggacagaggatgtacgggtagttcttgatcatcttcaacacgagttccctatggctcctctctttgctattggaactagcattggcgctaatattctggtgaaataccttggggaagagggtgagaagactcctctgaggggcggtgttgctatttgctctccatgggacctcttgattggtgacaggtttatctcccgaaaattcaaacaaaggttgtacgacagagctctaaccatcggacttcaaggttatgcccaattacatgaacctcagtatacacggcttgctaattgggaaggcataaaaaagtcacgttccatccgagattttgacaatcatgctacatgtcatgtcgggaaatttgagactgtggatacgttttaccgaaaatctagcagtacccaatacgtaggaaacgtggcggtgccgctactctgtatcagtgctctagatgatcccttatgcacaaaggaagctatcccttgggaagaatgccgggcaaacaaaaacattgtcttggtgacaacaaatcacgggggacatctagcttttttcgaaggattaactgcatctagcttgtggtgggttcgggccaccaacgagtttcttggcgcccttagctgcagtcgctatatgcatacacagaaaattcaagagagtggaagctcaggatcaagaaagcaggaggaaccttcaataaaccaaggcccgtacctgaacattggagaagacgggttggtagcagcagtcaacttggaggaaaacaccacacggtcaaaagatgcaacacaagtattgaaacagagaggaccaaaggttaaagataagagaagctttaacgtgttgtgccgccagacaaaacggtccatatggttgcttggttacataggcatggtaacaggtttccctttagttgggatgctcatgaactacctctttcgtaagaagcaacgacccataacagcctccaagtcctga

SEQ ID NO: 391 - protein, 530 aa, Brassica napus
MDDPTTPSPYDLLFEGLWLIPIRHYLYALILIWTVFFYNFVEFHFLGDAVLQYFRGRVNLIYNPDSPIYHGVVSRCRTLHGRYVATPWLASPHLQTCFLNFHGLPPVFTYTRKLFRASDGGTIALDWLTNSHVDDADPHNQNEISKEDTTPIAVVIPGLTSDSSSAYLKHLAYNTAKSGWNVVISNHRGLGGISVTSDCFYNAGWTEDVRVVLDHLQHEFPMAPLFAIGTSIGANILVKYLGEEGEKTPLRGGVAICSPWDLLIGDRFISRKFKQRLYDRALTIGLQGYAQLHEPQYTRLANWEGIKKSRSIRDFDNHATCHVGKFETVDTFYRKSSSTQYVGNVAVPLLCISALDDPLCTKEAIPWEECRANKNIVLVTTNHGGHLAFFEGLTASSLWWVRATNEFLGALSCSRYMHTQKIQESGSSGSRKQEEPSINQGPYLNIGEDGLVAAVNLEENTTRSKDATQVLKQRGPKVKDKRSFNVLCRQTKRSIWLLGYIGMVTGFPLVGMLMNYLFRKKQRPITASKS

SEQ ID NO: 392 - DNA, 1635 bp, Brassica napus
  CDS (1)..(1635)
atgcaatcgtcaacgtacgcagctgttaaaggaaacgctgcgtttgcgtttcagagacgtagcttctctaacctcgtcagcagatcggcgactactaccggaattcgcttctccaccggctcttacttcgcacaactccactcttccgcctcgaaagccatgggagcgaagcttgctcgcgctgagaacgggattcacagtctctcctcggtcaaagctcgatcggttagagcacaagcctcctctggtggtggtgacgaagaagaagcaatacctctgagatctgaaggaaaaatctcagggacggttttacccttcgttggtgttgcttgtcttggtgctatcttgtttggttatcatctcggggttgttaacggtgctcttgagtaccttgctaaggatcttggtatcgctgataatgctgttttgcaagggtggattgttagcgcgttgcttgctggtgcaacggtcggttctttcaccggaggtgcattagctgacaaatttggaagaactagaacttttcaattggatgctatcccgcttgctattggagctttcttatgtgcaacagctcagagtgtgcagactatgattgtgggacgtctgctcgcaggggttggaatcggaatctcatcagccattgtaccactttacatctccgagatatcaccaactgaaattcgcggtgcactcggatctgtgaaccagttgttcatatgtattggaatactcgcagccttgatagctggattaccccttgcagcaaaccctctatggtggaggacgatgtttggtgttgcagttatcccttccgttctattagccataggaatggggttttctccagaaagcccaaggtggctcgttcagcaaggaaaacttactcaagcggaaaaggctatcaaaactctgtatggtaaagaaaaagtggttgaactagtgcgtgacttatcaaactctggccaaggtacttctgagccagaggcaggatggtttgatctattcagcagccgctactggaaagttgtaagcgttggtgcggcgctcttcttgtttcagcagttagctgggataaatgcagttgtgtactactctacatctgtgttccgcagcgccggaatccaatctgatgttgcagccagtgctcttgttggagcatcaaacgtgtttggaactgctgttgcttcgtctttgatggacaaaatgggaaggaaaagtcttctacttactagctttggtggaatggcgttgtctatgctgttgctctcgttgtccttcacatggaaggctcttgctgcatattctggcactcttgctgttgttggaactgttctatatgtcctgtcattttcgcttggtgctggcccagtaccggctcttttgcttccagagatattcgcatccaggatcagagcaaaagccgtcgctctttctctcggcatgcactggatctcaaactttgtgattggactctacttcttgagcgttgtgactaaattcggaatcagcagtgtctacttgggattcgcaggagtgtgtgtccttgcagtcatgtacattgcaggaaacgtggtggagactaaaggacggtcactcgaggaaatagagcttgctcttacatccggagcttaa

SEQ ID NO: 393 - protein, 544 aa, Brassica napus
MQSSTYAAVKGNAAFAFQRRSFSNLVSRSATTTGIRFSTGSYFAQLHSSASKAMGAKLARAENGIHSLSSVKARSVRAQASSGGGDEEEAIPLRSEGKISGTVLPFVGVACLGAILFGYHLGVVNGALEYLAKDLGIADNAVLQGWIVSALLAGATVGSFTGGALADKFGRTRTFQLDAIPLAIGAFLCATAQSVQTMIVGRLLAGVGIGISSAIVPLYISEISPTEIRGALGSVNQLFICIGILAALIAGLPLAANPLWWRTMFGVAVIPSVLLAIGMGFSPESPRWLVQQGKLTQAEKAIKTLYGKEKVVELVRDLSNSGQGTSEPEAGWFDLFSSRYWKVVSVGAALFLFQQLAGINAVVYYSTSVFRSAGIQSDVAASALVGASNVFGTAVASSLMDKMGRKSLLLTSFGGMALSMLLLSLSFTWKALAAYSGTLAVVGTVLYVLSFSLGAGPVPALLLPEIFASRIRAKAVALSLGMHWISNFVIGLYFLSVVTKFGISSVYLGFAGVCVLAVMYIAGNVVETKGRSLEEIELALTSGA

SEQ ID NO: 394 - DNA, 1302 bp, Brassica napus
  CDS (1)..(1302)
atggagatcgctactgtcgtcaaggcaaatggcggttgcgaagcggatcgacggcggcggctccgccggttgagatgctccgtgaaggattacgcttggggcaaaatcgggtcggattcactcgtgtacagagtctacgcggcgaattcggatcaaccaatcgattcgacgcgaccgtacgcggagctttggatggggactcacgagtcaggtccgagttacttggaggatgatgatgctgatggtggcgtgacgcttagatcgtggattgctgaaaaccctgaggctcttggagatagggttttggagaaatggggttgtgatctcccctttctcttcaaggtgttgtcggtgggaagggccttgtcgattcagtcacatccggataaggttttggcgaagaaattgcataaagctcatcctaatctatataaagatgataatcacaagcctgagatggcattggcttatactcagttcgaggctctttgtgggtttatacctctacaggaacttaagagtgtgattcgtgctattccggagatagaagagcttgttgggagtgaagaggcaaaccaagtcttctgcatcagtgaacatgatgaggagaaagtcaaatctgctgtccgaactatcttcaccctgctaatgtctgcaggtcccgacacaacaaagcaaatcgtatccaaactgaaacaccgcctgcatatggagagtcaggaacgccatctgacagacaaggaacggctagttttgaagcttgagaagcagtatccagatgacattggggtcatctctgcattcttcttcaactacgtgaagctcaatcctggtgaagccttgtaccttggtgcaaacgagccacatgcttacttattcggtgagtgcattgaggtcatggccacttcagacaacgtagtacgagctggcctcacttccaagcctctggatattcaaacactttgttccatgctctcatacaaactgggctttcctgagatcctaaagggatcaaggattcgaccatacatcacaagatacctcccgcctttcgaggagtttgaggttgatctctgtgatcttccctgtggagcctcgaccgtgtttccctctgttccaggcccttctcttctgcttgtgctccaaggcgaaggaataatgtctacggatgcttcagcagatgaggtttccgtgggagatgttctgtttgtgcctgcagatactgagattcaattaaagtcttcagctgacttgaagctgtacagagcaggaattaacagtaggtttttggattctccatag

SEQ ID NO: 395 - protein, 433 aa, Brassica napus
MEIATVVKANGGCEADRRRRLRRLRCSVKDYAWGKIGSDSLVYRVYAANSDQPIDSTRPYAELWMGTHESGPSYLEDDDADGGVTLRSWIAENPEALGDRVLEKWGCDLPFLFKVLSVGRALSIQSHPDKVLAKKLHKAHPNLYKDDNHKPEMALAYTQFEALCGFIPLQELKSVIRAIPEIEELVGSEEANQVFCISEHDEEKVKSAVRTIFTLLMSAGPDTTKQIVSKLKHRLHMESQERHLTDKERLVLKLEKQYPDDIGVISAFFFNYVKLNPGEALYLGANEPHAYLFGECIEVMATSDNVVRAGLTSKPLDIQTLCSMLSYKLGFPEILKGSRIRPYITRYLPPFEEFEVDLCDLPCGASTVFPSVPGPSLLLVLQGEGIMSTDASADEVSVGDVLFVPADTEIQLKSSADLKLYRAGINSRFLDSP

SEQ ID NO: 396 - DNA, 702 bp, Brassica napus
  CDS (1)..(702)
atggatctcaatctcgatgcgccgcactctatggggacgaccatcatcggcgtcacttacaacggaggcgtcgtcctcggagccgactcacgtaccagtacaggcatgtacgtagcgaatcgagcttcagacaagatcactcaactcactgacaatgtctacgtctgccgttctggatcggctgctgattctcaggttgtttctgactacgtccgttacttccttcaccagcatacaattcagctgggacagcctgcgactgtaaaggtttctgccaacctcattaggatgctcgcttacaataacaagaacatgctgcaaactggcctcattgttggtggctgggataagtatgaaggcgggaagatctacgggattccacttggtggaactgttgtggagcagccgtttgctattggaggctctggctcgagttacctatacgggttctttgatcaggcctggaaagaaaacatgaccaaagaagaagctgagcaacttgttgtgaaggcggtttcactagccatcgcccgtgatggagccagtggaggagtcgtacgaactgtcattataaactctgagggagtgaccagaaacttctaccctggggataagttgcagctttggcatgaggagttggagcctcagaactccttgttagacatcctcaacgctgctggtcctgaaccaatggccatgtga

SEQ ID NO: 397 - protein, 233 aa, Brassica napus
MDLNLDAPHSMGTTIIGVTYNGGVVLGADSRTSTGMYVANRASDKITQLTDNVYVCRSGSAADSQVVSDYVRYFLHQHTIQLGQPATVKVSANLIRMLAYNNKNMLQTGLIVGGWDKYEGGKIYGIPLGGTVVEQPFAIGGSGSSYLYGFFDQAWKENMTKEEAEQLVVKAVSLAIARDGASGGVVRTVIINSEGVTRNFYPGDKLQLWHEELEPQNSLLDILNAAGPEPMAM

SEQ ID NO: 398 - DNA, 1437 bp, Brassica napus
  CDS (1)..(1437)
atggcgaatacgacctccctcgtctccgatttcctctcctttctcaacgcttctcccaccgcttttcacgccgtcgatgagtcaaagaggcggctacgacacgctggctatgaacagatttccgagagagatgactggaaactcgaagccggcaaaaagtatttcttcacaaggaactactccaccatcgtcgcttttgctgttggcaaaaaatacgaagctggaaacggattccatataataggtgctcacactgatagcccttgcctcaaactcaagcctgtttctaaggtaaccaaaggtggatgcttggaggttggtgttcagacttatggaggtggcctttggtacacttggtttgatcgtgacttgactgttgctggacgtgttattgtcaaagaagacaaggcgggttctgtctcttattctcatcgtcttgtcaggattgaggatcctatcatgaggattcctaccttggccattcacttggacaggaatgtgaacagtgaaggttttaagccaaacactcagacgcaccttgttccaatactcgcaacggctatcaaggcggagctcaataaagtgccagcagaaggtggtgaagaggacggagaaaaaaagtgtactgaaagtagttcaaaatcaaagcatcacccacttctaatggagatcattgcaaatgcactgggttgtaatcctgatgagatatgcgaatttgagctgcaagtatgtgacactcagccaagcattctaggtggtgcagcaaaagaatttattttctcaggaaggctggacaatctttgcatgtcattttgctctctaaaggcacttatagatgcaacgtcctctggaagtgacctagaggaagaaagtggagtaagaatggtggcattatttgatcacgaagaagttggttccaactcagcgcaaggagctggatcccctgtcatgattgatgctatgtcacacatcacaagttgcttcagctctgacgctaaggtgctcaagaaagcgattcaaaaaagcttgcttgtttccgctgacatggctcatgctttacatccaaactttatggacaaacacgaagagaatcatcaaccaaagatgcatggagggcttgtcatcaagcacaatgcaaatcaacgttacgcaaccaatgcagtaacttcgtttgtgttcagagagatagcagagaaacataatctccctgtccaggattttgtggtacgtaatgatatgggttgcggatcaaccattggtccaatcctagcaagcagtgtggggataaggacggttgatgttggagctccacagctctcgatgcatagcatccgggagatgtgtgctgcggacgacgtgaagcattcatacgagcacttcaaagctttcttccaagagttcactcaccttgacgccaaactcactgtcgacgtttga

SEQ ID NO: 399 - protein, 478 aa, Brassica napus
MANTTSLVSDFLSFLNASPTAFHAVDESKRRLRHAGYEQISERDDWKLEAGKKYFFTRNYSTIVAFAVGKKYEAGNGFHIIGAHTDSPCLKLKPVSKVTKGGCLEVGVQTYGGGLWYTWFDRDLTVAGRVIVKEDKAGSVSYSHRLVRIEDPIMRIPTLAIHLDRNVNSEGFKPNTQTHLVPILATAIKAELNKVPAEGGEEDGEKKCTESSSKSKHHPLLMEIIANALGCNPDEICEFELQVCDTQPSILGGAAKEFIFSGRLDNLCMSFCSLKALIDATSSGSDLEEESGVRMVALFDHEEVGSNSAQGAGSPVMIDAMSHITSCFSSDAKVLKKAIQKSLLVSADMAHALHPNFMDKHEENHQPKMHGGLVIKHNANQRYATNAVTSFVFREIAEKHNLPVQDFVVRNDMGCGSTIGPILASSVGIRTVDVGAPQLSMHSIREMCAADDVKHSYEHFKAFFQEFTHLDAKLTVDV

SEQ ID NO: 400 - DNA, 450 bp, Glycine max
  CDS (1)..(450)
atggcagatcaactcaccgatgaacagatctcggagttcaaggaagccttcagtttgttcgataaggatggcgatggttgcatcacaacaaaggagcttgggactgttatgcgttcgttgggtcagaatccaacagaggctgagctccaagacatgatcaatgaagtagatgctgatgggaatggcaccattgacttccctgagttcttgaacctcatggctagaaagatgaaggacactgattctgaggaggagctgaaagaggcgttccgagtgtttgacaaggaccagaatgggttcatttctgctgctgagctccgccatgtgatgaccaaccttggggagaagctcactgatgaagaggttgatgagatgattcgagaggctgatgtcgatggcgacggccaaataaactacgaggagtttgttaaggtcatgatggccaagtga

SEQ ID NO: 401 - protein, 149 aa, Glycine max
MADQLTDEQISEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 402 - DNA, 591 bp, Glycine max
  CDS (1)..(591)
atgagtacggcaaggtttatcaagtgtgtaacagttggagatggtgctgtgggaaagacatgcatgcttatatcctataccagcaatacctttcccacggattatgttccaacagtgtttgacaatttcagtgctaatgtaacggtggatggtagtactgttaatcttggtttatgggacactgcaggacaagaagattacaacaggctaaggcctttaagctatagaggagctgatgtgtttttgttgtgctattctctcatcagcaaagccagttatgagaacatctccaaaaagtggatacctgagctaagacattatgctccaaatgtgcctatagtgctggtgggaacaaaactagatttgcgagatgacaagcaatttctgattgatcatccgggatccgcacgaataacaactgctcagggtgaagaattgaagaaaatgattggtgcagtcacttatattgagtgcagctccaaaacacagctgaatgtgaagacagtttttgatgctgcaataaaggttgcattgaagccaccaaagccaaagaagaaaccacgcaagaaaaggacctgtactttcctctga

SEQ ID NO: 403 - protein, 196 aa, Glycine max
MSTARFIKCVTVGDGAVGKTCMLISYTSNTFPTDYVPTVFDNFSANVTVDGSTVNLGLWDTAGQEDYNRLRPLSYRGADVFLLCYSLISKASYENISKKWIPELRHYAPNVPIVLVGTKLDLRDDKQFLIDHPGSARITTAQGEELKKMIGAVTYIECSSKTQLNVKTVFDAAIKVALKPPKPKKKPRKKRTCTFL

SEQ ID NO: 404 - DNA, 594 bp, Glycine max
  CDS (1)..(594)
atgagcacaacacggtttattaagtgtgtcacagttggtgatggggctgtgggaaagacttgcatgcttatctcttacactagcaacactttccccacggattatgttcctacagttttcgacaatttcagtgcaaatgttgtggttgatggcagcacagttaacctgggattgtgggacactgctggacaggaagattacaacaggcttaggccattgagttacagaggagcagatgtgttcttgctggccttttccctcatcagcaaagccagctatgaaaatatatctaaaaagtggattcctgaattgagacattatgccccaactgtgcctattgtactggttggaactaaacttgatttgagggaagacaggcaatatttgattgatcatcctggaaccacagctatagctactgcccagggagaagaactgaagaaggcaattggtgctgctgtgtacatagagtgcagctcaaagactcagcagaatgtgaaggccgtgtttgatgctgcaatcaaggttgttttgcaaccacctaagtccaagaaaaaaggaaagaagaagaacacgccttgtgttttcctctga

SEQ ID NO: 405 - protein, 197 aa, Glycine max
MSTTRFIKCVTVGDGAVGKTCMLISYTSNTFPTDYVPTVFDNFSANVVVDGSTVNLGLWDTAGQEDYNRLRPLSYRGADVFLLAFSLISKASYENISKKWIPELRHYAPTVPIVLVGTKLDLREDRQYLIDHPGTTAIATAQGEELKKAIGAAVYIECSSKTQQNVKAVFDAAIKVVLQPPKSKKKGKKKNTPCVFL

SEQ ID NO: 406 - DNA, 591 bp, Glycine max
  CDS (1)..(591)
atgagtgcgtcgaggttcattaagtgcgtcaccgtcggcgacggtgctgtcggcaaaacctgcttgttgatttcctacaccagcaacacttttcccacggactatgtgcccaccgtttttgacaatttcagtgctaatgtggtggtggatggaagcaccgtaaacctaggattgtgggatacagctggtcaggaggattacaatagattaagacccttgagctatcgaggagctgatgtcttcatacttgccttttctctcataagcaaggctagctatgaaaatattgcaaagaagtggatccctgaactaaggcattatgcccctggtgttccaataattctcgttggaacaaagttagatcttcgggatgataagcaattttttatggaccatcctggtgcagtgccaattactacagcacagggagaagaattgagaaagctgattggtgctccggcctacattgagtgtagttccaaaacgcaacagaacgtgaaagctgtctttgacgcggcaatcaaagtggttatccaaccaccaaagctaaagaaaaagagaaaaacacagaaagcttgctccatattatga

SEQ ID NO: 407 - protein, 196 aa, Glycine max
MSASRFIKCVTVGDGAVGKTCLLISYTSNTFPTDYVPTVFDNFSANVVVDGSTVNLGLWDTAGQEDYNRLRPLSYRGADVFILAFSLISKASYENIAKKWIPELRHYAPGVPIILVGTKLDLRDDKQFFMDHPGAVPITTAQGEELRKLIGAPAYIECSSKTQQNVKAVFDAAIKVVIQPPKLKKKRKTQKACSIL

SEQ ID NO: 408 - DNA, 1185 bp, Glycine max
  CDS (1)..(1185)
atgtcggacgatgaaagggaggagaaggagttggatctctcttctgcagaagttgtaaccaaatacaaaaccgcggctgagatcgttaacaaggccttgaagctagttatttcagaatgtaaaccaaaggcgaagattgtggatatttgtgagaaaggggattcatacattcgagagcaaactggaaatgtgtacaagaatgtgaagaggaagattgagagaggtgttgctttccctacatgtttgtctgtaaacaacgttgtctgccatttctctccactagccagtgacgaggcagtgttggaagaaggtgatatattgaaaattgatatggcatgtcatatagatggattcattgctgccgtagctcacacccatgttcttcaggaaggtcctgttacaggaagggcagctgatgtcattgctgccgcaaatactgctgctgaggtggccttgaggcttgtcaggccaggaaagaagaacaaggatgtaagtgatgcaattcaaaaggttgctgctgcctatgactgtaaaatcgttgagggtgttcttagccaccaaatgaagcagtttgttattgatgggaataaagttgtgcttagtttgtctaatccggacacaagggttgacgaagcagagtttgaggagaatgaagtttatgcaattgatatagtaacaagcactggggacggcaagcctaagctgttggatgagaagcagacaactatctataagagggctgttgacaagagttatcacttgaagatgaaagcgtctaggttcattttcagtgaaataagccaaaagtttcctatcatgccgttctctgctagggctttggaagagaaaagagctcgacttggtttggtggaatgcgtcaaccatgagctcttgcagccatatcctgttttgcatgaaaagcctggtgatttggttgcgcacatcaaattcacagtcttgttgatgccaaatggatcggatcgaatcacaactcatccactccaagaattgcagcctacaaaaacaatagatgatcctgatattaaggcctggctagccttgggcacaaagacaaagaagaaaggtggtgggaagaagaaaaaaggtaagaaaggggacaaggcagatgagacaactgaagctgaggctatggactcaacaaacggggccactcctcaagagtga

SEQ ID NO: 409 - protein, 394 aa, Glycine max
MSDDEREEKELDLSSAEVVTKYKTAAEIVNKALKLVISECKPKAKIVDICEKGDSYIREQTGNVYKNVKRKIERGVAFPTCLSVNNVVCHFSPLASDEAVLEEGDILKIDMACHIDGFIAAVAHTHVLQEGPVTGRAADVIAAANTAAEVALRLVRPGKKNKDVSDAIQKVAAAYDCKIVEGVLSHQMKQFVIDGNKVVLSLSNPDTRVDEAEFEENEVYAIDIVTSTGDGKPKLLDEKQTTIYKRAVDKSYHLKMKASRFIFSEISQKFPIMPFSARALEEKRARLGLVECVNHELLQPYPVLHEKPGDLVAHIKFTVLLMPNGSDRITTHPLQELQPTKTIDDPDIKAWLALGTKTKKKGGGKKKKGKKGDKADETTEAEAMDSTNGATPQE

SEQ ID NO: 410 - DNA, 765 bp, Glycine max
  CDS (1)..(765)
atggccgtcgttggcgtcctcgcgctgcaaggatctttcaacgaacacatagctgctcttagaaggttaggggtgcaaggcgtggagattcgaaagccagagcagcttaacacaattagttccctcattatccctggtggagaaagcaccaccatggctaagctcgccgagtatcacaacctgtttcctgctttgcgagagtttgtacaaatgggaaagcctgtttggggaacctgtgcagggcttatattcttggcaaataaagctataggacagaagactggtggtcaatatttggttggtggacttgattgtacagtgcatagaaatttctttggcagccagattcaaagctttgaggcagagctttcagtgccggagcttgtctccaaggaaggaggtcctgaaacattttgtggaatttttattcgtgcccctgcaattcttgaagcagggccagaagttcaagtgctggctgattatcctgtaccttctagcagattgttgagttctgattcctctattgaagaccaaacggagaatgctgagaaagaaagtaaagttatagttgctgtgagacaagggaacatattagccactgctttccatcctgaattgacagccgatactcgatggcatagttatttcgtaaaaatgtcaaatgaaattagagaagaggcctcttcgagtagccttgttcctgcacaagtcagtagtacaagtcaatatcaacagccccggaatgaccttcctatctatcgatag

SEQ ID NO: 411 - protein, 254 aa, Glycine max
MAVVGVLALQGSFNEHIAALRRLGVQGVEIRKPEQLNTISSLIIPGGESTTMAKLAEYHNLFPALREFVQMGKPVWGTCAGLIFLANKAIGQKTGGQYLVGGLDCTVHRNFFGSQIQSFEAELSVPELVSKEGGPETFCGIFIRAPAILEAGPEVQVLADYPVPSSRLLSSDSSIEDQTENAEKESKVIVAVRQGNILATAFHPELTADTRWHSYFVKMSNEIREEASSSSLVPAQVSSTSQYQQPRNDLPIYR

SEQ ID NO: 412 - DNA, 639 bp, Glycine max
  CDS (1)..(639)
atggcttccgcaactgccccaagattcatcaagtgcgtgaccgttggtgatggagctgtagggaagacctgcatgctcatttgctataccagcaacaaattccccacggactatatccccactgtgtttgataatttcagtgcaaatgtggttgttgaaggcataactgtcaacttaggcctttgggatacagctgggcaagaggattacaacaggctgaggcccttgagctacaggggggcagatgtctttgtcttggctttttctttagttagtcgcgcgagctatgagaatgtgctgaagaagtggatccctgaactccagcattttgcccctggcatcccgttggtgttagttggcaccaaattggatctacgagaagacaagcactacatggctgatcatcccagcttggtgccagtgactactgatcaaggtgaggaactccgtaaacacattggagctacctactatattgagtgcagctcaaaaactcagcagaatgtgaaggcagtttttgatgctgctattagaatggtcatcaagcctccacaaaagcaaaacgagaaaagaaagaaaaaaccacgtggctgtttcctaaacgtcctctgtcgaaggaacattgttcgccttaaatga

SEQ ID NO: 413 - protein, 212 aa, Glycine max
MASATAPRFIKCVTVGDGAVGKTCMLICYTSNKFPTDYIPTVFDNFSANVVVEGITVNLGLWDTAGQEDYNRLRPLSYRGADVFVLAFSLVSRASYENVLKKWIPELQHFAPGIPLVLVGTKLDLREDKHYMADHPSLVPVTTDQGEELRKHIGATYYIECSSKTQQNVKAVFDAAIRMVIKPPQKQNEKRKKKPRGCFLNVLCRRNIVRLK

SEQ ID NO: 414 - DNA, 786 bp, Glycine max
  CDS (1)..(786)
atggccgtcggaaagaacaagcgcatctccaaagggaaaaagggtggcaagaagaaggcagctgatccctttgccaagaaggattggtatgacattaaggccccttctctttttcaagtgaaaaatgttggcaaaaccctcgtctctcgtacgcagggtaccaagattgcttctgaaggacttaaacatagagtgtttgaggtctccttggctgatcttcaaggggatgaggatcatgcattcaagaagattaggttgagagctgaagatgtgcaagggaagaatgtcctgacaaatttctggggaatggatttcacaactgacaagctgaggtcattggtgcgaaaatggcaaactctaattgaagcccatgtggatgtgaagacaactgataactacacattgaggatgttttgcattggatttaccaagagaagagctaaccaagtgaagagaacctgctatgcacaatcaagccagattagacagattcgtaggaagatgagggagatcatgaccaaccaggcaacatcctgtgatttgaaggagttggtccgcaagtttattcctgagattattggaaaagagattgagaaggcgacatctagtatttaccctctgcagaatgtgtttgttcgtaaagtcaagatcctgaaagcccctaagtttgatcttgggaaactgatggaggttcatggagattactcagaggatgttggtgccaaggtagacagacctgctgatgaaatagtggcagaggaacccactgaaattgttggagcttga

SEQ ID NO: 415 - protein, 261 aa, Glycine max
MAVGKNKRISKGKKGGKKKAADPFAKKDWYDIKAPSLFQVKNVGKTLVSRTQGTKIASEGLKHRVFEVSLADLQGDEDHAFKKIRLRAEDVQGKNVLTNFWGMDFTTDKLRSLVRKWQTLIEAHVDVKTTDNYTLRMFCIGFTKRRANQVKRTCYAQSSQIRQIRRKMREIMTNQATSCDLKELVRKFIPEIIGKEIEKATSSIYPLQNVFVRKVKILKAPKFDLGKLMEVHGDYSEDVGAKVDRPADEIVAEEPTEIVGA

SEQ ID NO: 416 - DNA, 594 bp, Glycine max
  CDS (1)..(594)
atgagtgcgtccaggttcatcaagtgtgtcactgtgggtgacggtgccgttggcaagacttgcatgctcatctcctacaccagcaacacttttcctacggactacgtgccaactgtctttgacaatttcagtgcaaatgtcgttgtggatggaagcactgtgaatcttgggttgtgggatactgctggccaagaagattacaatagattgagacccttaagctatcgtggagcagatgtattcctgcttgctttctctctcataagcagggccagctatgaaaatgttgccaagaaatggattcctgagttgaggcattatgctcctggtgttccaattattcttgttggaacaaaacttgatcttcgggatgataagcagttctttcaagaccatcctggtgcagtgcctatcaccacagcacagggtgaggaactgagaaagcttatcggtgctccaatttacattgaatgtagttcaaaaacacaacagaatgtgaaggctgtttttgatgcagccatcaaggtagttctccagcccccaaagcagaagaaaaagaagagaaagggacaaaaggcctgttccattttgtga

SEQ ID NO: 417 - protein, 197 aa, Glycine max
MSASRFIKCVTVGDGAVGKTCMLISYTSNTFPTDYVPTVFDNFSANVVVDGSTVNLGLWDTAGQEDYNRLRPLSYRGADVFLLAFSLISRASYENVAKKWIPELRHYAPGVPIILVGTKLDLRDDKQFFQDHPGAVPITTAQGEELRKLIGAPIYIECSSKTQQNVKAVFDAAIKVVLQPPKQKKKKRKGQKACSIL

SEQ ID NO: 418 - DNA, 1185 bp, Glycine max
  CDS (1)..(1185)
atgcctcccaaatctgccaaatccaaggaagctccagctgagcgacccatcctcggtcgattctcttctcacctcaaaattggcattgttggcttgccaaatgttggaaagtctactctctttaatactctcaccaagttggcaatacctgctgagaacttccccttttgcaccattgagcctaatgaggcacgggtcaatgtacccgatgaacggttcgagtggctttgccaattattcaagccaaaaagtgaggtctcggctttcttagaaatccatgacatagctggattggtccgaggtgctcatcaggggcaaggattggggaatagttttttatctcacatccgtgctgtagatggcattttccatgttttacgtgcatttgaggatccggacattattcacgttgatgatactgttgacccagtcagggatttagaggtcattactgaagaattgcggctgaaggatattgaattcatggaaagaaagatagaagatattgagaaaagcatgaagaggagcaatgacaaacagttaaaaatcgagcttgaatgttgtcaaagggtgaaggcattgcttgaggaaggaaaagatatacgtctaggggattggaaggctgctgatattgaaattttgaattcctttcagttgctgactgccaagcctgttgtatacttggttaatatgacagaaaaagattaccaaagaaaaaagaacaagtttctgcccaaaattcatgcatgggtccaagagcacggtggtgagactattattcctttcagctgtgccttggaaaggaatcttgcagatatgccaccagatgaagctgctaagtattgtgaggagaacaaaacacaaagtgctcttaccaaaataataaagactggattttcagctattaatctcatttactttttcactgcaggacctgatgaggttaagtgttggcaaattcgacgccaaacaaaggctccccaagctgcaggggctatccatactgattttgaaagaggatttatttgtgctgaggtgatgaagtttgaggatctaaaggaacttggtagtgagtcagctgtgaaggctgctggaaagtataaacaggaagggaaaacgtatgtggtccaagatggagacattatattctttaagttcaacgtttctggtgggggcaagaagtaa

SEQ ID NO: 419 - protein, 394 aa, Glycine max
MPPKSAKSKEAPAERPILGRFSSHLKIGIVGLPNVGKSTLFNTLTKLAIPAENFPFCTIEPNEARVNVPDERFEWLCQLFKPKSEVSAFLEIHDIAGLVRGAHQGQGLGNSFLSHIRAVDGIFHVLRAFEDPDIIHVDDTVDPVRDLEVITEELRLKDIEFMERKIEDIEKSMKRSNDKQLKIELECCQRVKALLEEGKDIRLGDWKAADIEILNSFQLLTAKPVVYLVNMTEKDYQRKKNKFLPKIHAWVQEHGGETIIPFSCALERNLADMPPDEAAKYCEENKTQSALTKIIKTGFSAINLIYFFTAGPDEVKCWQIRRQTKAPQAAGAIHTDFERGFICAEVMKFEDLKELGSESAVKAAGKYKQEGKTYVVQDGDIIFFKFNVSGGGKK

SEQ ID NO: 420 - DNA, 993 bp, Glycine max
  CDS (1)..(993)
atgccttcaattccagaagagccattgttggcaccgaacccggaccggttctgcatgttcccaatccaatatcctcaaatctgggaaatgtacaagaaagccgaagcctcgttctggacggcggaggaggtggacctctcgcaggacctccgccactgggactccctgaccgacggcgagcgccacttcgtcagtcacgtcctcgccttcttcgccgcctccgacggcatcgtacttgagaacctcgctgggcgcttcacgaaggaaatccaaatccccgaggcccgcgccttctacggcttccagatcgccatcgagaacattcactccgagatgtacagcctcctcctcgaaacctacatcaaggactcctcccagaagagccacctcttccgcgccatcgacaccatcccgtgcgttaccaagaaagcccagtgggccctacgctggatcgattcctccgactccttcgccgagcgtctcgttgccttcgcatgtgtggaaggtatcttcttctccggaagcttctgcgctgtcttctggctcaaaaaacgtggactcatgcccggactcactttctcaaatgaactaatatcacgcgatgaaggtcttcattgtgatttcgcttgtcttttatactctctgctgagacagaagctcaccgaggagcgcgtaagggagattgtgaaggacgcggtggacattgaacgggagtttgtgtgcgacgcgcttccctgcgcgttggtggggatgaacggtgatttgatgagccagtacattgaatttgttgcggatcggttgctgggtgcgctagggtgcgggaaggtgtacaatgttcagaatccgttcgattggatggagctcatttctctgcaggggaagaccaacttcttcgagaagcgcgtcggggaatatcagaaggcttctgttatgtccagcttgaacgggaacggtggtgggaaccacgtgttcaagatggatgaggatttctaa

SEQ ID NO: 421 - protein, 330 aa, Glycine max
MPSIPEEPLLAPNPDRFCMFPIQYPQIWEMYKKAEASFWTAEEVDLSQDLRHWDSLTDGERHFVSHVLAFFAASDGIVLENLAGRFTKEIQIPEARAFYGFQIAIENIHSEMYSLLLETYIKDSSQKSHLFRAIDTIPCVTKKAQWALRWIDSSDSFAERLVAFACVEGIFFSGSFCAVFWLKKRGLMPGLTFSNELISRDEGLHCDFACLLYSLLRQKLTEERVREIVKDAVDIEREFVCDALPCALVGMNGDLMSQYIEFVADRLLGALGCGKVYNVQNPFDWMELISLQGKTNFFEKRVGEYQKASVMSSLNGNGGGNHVFKMDEDF

SEQ ID NO: 422 - DNA, 594 bp, Glycine max
  CDS (1)..(594)
atgagcgcttctaggttcatcaagtgcgtcactgttggggatggtgctgtgggcaaaacctgtttgcttatttcctacaccagcaacacttttcccaccgattatgtgccgactgtttttgacaatttcagcgcaaatgtggttgtcaatgggagcattgtgaatctgggtttgtgggatactgctggacaagaggattataacagattaagacctttgagttaccgtggtgccgatgttttcatactggctttctctctcataagcaaggccagttatgaaaatgtctctaaaaagtggattccggagttgaagcattatgctcctggtgtccccattattctggttggcacaaagcttgaccttcgggatgataagcagttctgcattgaccatcctggtgccgtacctattaccacagctcagggagaagagcttaggaagctgattaatgcgccagcttacattgaatgcagttcaaaaacacaggagaacgtgaaggcagtctttgatgcagccataagagttgtccttcaaccacctaagcagaagaaaaagaagggtaaagcacaaaaggcctgttcgatattgtga

SEQ ID NO: 423 - protein, 197 aa, Glycine max
MSASRFIKCVTVGDGAVGKTCLLISYTSNTFPTDYVPTVFDNFSANVVVNGSIVNLGLWDTAGQEDYNRLRPLSYRGADVFILAFSLISKASYENVSKKWIPELKHYAPGVPIILVGTKLDLRDDKQFCIDHPGAVPITTAQGEELRKLINAPAYIECSSKTQENVKAVFDAAIRVVLQPPKQKKKKGKAQKACSIL

SEQ ID NO: 424 - DNA, 294 bp, Glycine max
  CDS (1)..(294)
atggcgaagcgcttgattccctgcttcaatcgcattctcgttgagaaaatcgtccctccctccaagacaagcgccggcattctcctccctgagaagtcctcccagcttaattccggtaaggtgatagcggttgggcctggatcacgtgaccaggcagggaacttgattccggtgtccgtgaaggaaggtgatcacgtgctcttgccggagtacggtggcacgcagatcaagctcgatgacaaagagttccatttgtttagggatgaggacatcttgggtattctgcatgattga

SEQ ID NO: 425 - protein, 97 aa, Glycine max
MAKRLIPCFNRILVEKIVPPSKTSAGILLPEKSSQLNSGKVIAVGPGSRDQAGNLIPVSVKEGDHVLLPEYGGTQIKLDDKEFHLFRDEDILGILHD

SEQ ID NO: 426 - DNA, 990 bp, Glycine max
  CDS (1)..(990)
atgccttcaattcccgaagagcccctcctggctccgaacccggatcgcttctgcatgttcccaatccaatacccccaaatctgggaaatgtacaagaaagccgaagcctcgttctggacggcggaggaggtggacctctcccaggacctccgccactgggactccctcaccgacggcgagcgccacttcgtcacccacgtcctcgccttcttcgccgcctccgacggcatcgtcctcgagaacctcgccgggcgcttcacaaaggagatccagctccccgaggcccgggccttctacggcttccagatcgccatcgagaacatccactccgagatgtacagcctcctcctcgaaacctacatcaaggactccgaccagaagaaccacctcttccgtgccatcgacaccatcccctgcgtcgctaagaaagcccagtgggcccttcgctggatcgattcctccgactccttcgccgagcgtctcgttgccttcgcatgtgttgaaggtattttcttctctggaagcttctgcgctatcttctggctcaaaaaacgaggactcatgccggggctcactttctcaaacgaactcatttctcgcgacgaagggctacactgcgatttcgcgtgtctgctctactctctgctgaggcagaagctcaccgaggagcgcgtgagggagattgtgagggacgccgtggatattgagcgggagtttgtctgcgacgcgctgccctgcgcgttggtggggatgaacggtgatttgatgagtcaatacattgagtttgtggcagatcggttgctgggggcgcttgggtgcgggaaggtgtacaatgttcagaacccgttcgattggatggagctgatttcgctgcagggaaagaccaacttcttcgagaagcgcgtcggggagtatcaaaaggcttctgttatgaacagcttgaacgggaacggtgggacccacgtcttcaagatggatgaggatttctaa

SEQ ID NO: 427 - protein, 329 aa, Glycine max
MPSIPEEPLLAPNPDRFCMFPIQYPQIWEMYKKAEASFWTAEEVDLSQDLRHWDSLTDGERHFVTHVLAFFAASDGIVLENLAGRFTKEIQLPEARAFYGFQIAIENIHSEMYSLLLETYIKDSDQKNHLFRAIDTIPCVAKKAQWALRWIDSSDSFAERLVAFACVEGIFFSGSFCAIFWLKKRGLMPGLTFSNELISRDEGLHCDFACLLYSLLRQKLTEERVREIVRDAVDIEREFVCDALPCALVGMNGDLMSQYIEFVADRLLGALGCGKVYNVQNPFDWMELISLQGKTNFFEKRVGEYQKASVMNSLNGNGGTHVFKMDEDF

SEQ ID NO: 428 - DNA, 1269 bp, Glycine max
  CDS (1)..(1269)
atggcaagagcagcttgcaatcaccttcacttggttcccagtttagttcatcctctaaagtcaaccctcttcacaaatcacactctttccaccacacgcactcgcttctatggcattcaccgaaggttctcttcttcttcatccaaaataagcatgagcctcaaggctggtattgttggccttcccaacgttggcaagtccactctcttcaatgccgttgtggaaaatggaaaggctcaagctgctaattttccattttgtacaatagagccaaatgtagggattgttgctgttccagattctcgtcttcacgtgctttctgatctcagcaaatctcaacgagcagttccagcatcaatagagtttgtagatattgctgggcttgtcaagggtgcaagtcaaggagagttgcagggtttgggcaataagtttttgtctcatattcgtgaggtggactctatacttcaggttgtacgatgttttgaagacaacgacattgttcatgtgaatgggaaagttgatcccaagtctgatattgatgttatcaatttggagcttgttttctcagatttggaccagattgaaaaaagaattgataagctaaagaaaggcaaggcaaaggattcacaaaaactcaaggaagaggcagaaaagtctgcactggaaaagattcgtgaggcgcttatggatggaaaacctgcgcgatctgttaccttaactgattttgaaagggatgctgtaaagcatctctgcttgctcaccatgaaacctgttatatatgtggcaaatgttgcagaatctgatctagctgatcctgcaaacaataattatgtcaaggacgtaacaaatgttgtgtctgagttgcagtccagaattgtaacaatttcagcacaggttgaggcagagcttactgaactaccagttgaagaacgacaagaatatttgcaatctcttggtgttagtgaaagtggtcttggcaacctaataagggcaacatatgaccttctgggtctcagaacttactttacttctggtgagaaggagacaaaggcatggacaatacttgcaggaatgactgcacctcaagcagctggagttattcactctgactttgagaagggtttcattcgagcagagacagtgtcttatgaggattttgttgctgctggttcactttctgcagcacgagagaaaggactgttgagatctgaaggtaaagactacgttgtacaagaagcagatgtcatgttgtttcgattcaatgtttag

SEQ ID NO: 429 - protein, 422 aa, Glycine max
MARAACNHLHLVPSLVHPLKSTLFTNHTLSTTRTRFYGIHRRFSSSSSKISMSLKAGIVGLPNVGKSTLFNAVVENGKAQAANFPFCTIEPNVGIVAVPDSRLHVLSDLSKSQRAVPASIEFVDIAGLVKGASQGELQGLGNKFLSHIREVDSILQVVRCFEDNDIVHVNGKVDPKSDIDVINLELVFSDLDQIEKRIDKLKKGKAKDSQKLKEEAEKSALEKIREALMDGKPARSVTLTDFERDAVKHLCLLTMKPVIYVANVAESDLADPANNNYVKDVTNVVSELQSRIVTISAQVEAELTELPVEERQEYLQSLGVSESGLGNLIRATYDLLGLRTYFTSGEKETKAWTILAGMTAPQAAGVIHSDFEKGFIRAETVSYEDFVAAGSLSAAREKGLLRSEGKDYVVQEADVMLFRFNV

SEQ ID NO: 430 - DNA, 594 bp, Glycine max; identical to SEQ ID NO: 416
  CDS (1)..(594)

SEQ ID NO: 431 - protein, 197 aa, Glycine max; identical to SEQ ID NO: 417

SEQ ID NO: 432 - DNA, 756 bp, Glycine max
  CDS (1)..(756)
atggcaacctctcaaatcactgcatcattgaggaacttgcctgcatttgaaaggtttcaaccttcagcgcttcgattttcttctgctgggcacgtcagaattggaacactcacgcaaccctcgtttccctctttcgttgtcaaagccgccactgttgttgcccccaagcacaccactgttaagcctctgggtgatagagtactggtgaaaattaaggatgcagaggagaagactgcaggtgggattttactgccagcaaatgctcaaggcaagcctcaagggggtgaagtggttgctgttggagaagggaagtcggttgggaagtgcaaagtggatgttagtgtgaagacaggtgcacaagttgtgcattcaaagtatgcagggactgaggtagagttcaatggttcaaaacatcttattctgaaggacgatgacattgttggtatccttgaaactgatgaggtcaaggatcttaaacccttgaacgatagagtcttgataaaggttgcagaagctgaggaaaaaactgctggaggtttgttgctcacagaggcaaccaaggagaaaccatctattggaacagtgatagcagttggtccggggcctctggatgaggaaggtaacagaaagccattgtccgtcatgcctgggaatacagttctgtactccagatatgcagggaatgacttcaagggcaaagatggttctgactacattgccttgagggcctcagatgtcatggctatcctgtcctag

SEQ ID NO: 433 - protein, 251 aa, Glycine max
MATSQITASLRNLPAFERFQPSALRFSSAGHVRIGTLTQPSFPSFVVKAATVVAPKHTTVKPLGDRVLVKIKDAEEKTAGGILLPANAQGKPQGGEVVAVGEGKSVGKCKVDVSVKTGAQVVHSKYAGTEVEFNGSKHLILKDDDIVGILETDEVKDLKPLNDRVLIKVAEAEEKTAGGLLLTEATKEKPSIGTVIAVGPGPLDEEGNRKPLSVMPGNTVLYSRYAGNDFKGKDGSDYIALRASDVMAILS

SEQ ID NO: 434 - DNA, 429 bp, Glycine max
  CDS (1)..(429)
atgatccgattcattctgttgcagaacaggcagggcaagacccgtcttgccaaatactacgttcctctcgaggattccgagaagcacaaggtggaatacgaggttcaccgcctcgtcgtaaacagagaccctaaatacacaaatttcgtcgagtttcgtacgcacaagataatatacaggcgatatgctgggttgtttttctcaatctgtgttgatatcactgataatgagttggcgtatttagagtgcatccatttgtttgtggaaatattggatcacttcttcagcaatgtctgtgagcttgatttggtttttaacttccacaaggtctatcttatacttgatgaattcattctagcgggtgaactgcaagaaacaagcaagaaggctattattgagagaatgggggaactggaaaaactagaatga

SEQ ID NO: 435 - protein, 142 aa, Glycine max
MIRFILLQNRQGKTRLAKYYVPLEDSEKHKVEYEVHRLVVNRDPKYTNFVEFRTHKIIYRRYAGLFFSICVDITDNELAYLECIHLFVEILDHFFSNVCELDLVFNFHKVYLILDEFILAGELQETSKKAIIERMGELEKLE

SEQ ID NO: 436 - DNA, 342 bp, Glycine max
  CDS (1)..(342)
atgtctgaattcgacacaaacatcccaactgcttttgatccctttgctgatgcaaatgctgaggactcaggtgctgggacgaaagagtatgttcatgttcgtgtacaacagcgcaacggaaggaaaagcctaacaactgttcaaggtttaaagaaagagtacagctatagcaagatactcaaggacctcaagaaagaattctgctgtaatggtactgttgtccaagaccctgagttgggccaggtcatacaacttcagggtgatcaaagaaagaatgtttctactttccttatgcaggctggcatagtaaagaaggaatacatcaagcttcatggtttctaa

SEQ ID NO: 437 - protein, 113 aa, Glycine max
MSEFDTNIPTAFDPFADANAEDSGAGTKEYVHVRVQQRNGRKSLTTVQGLKKEYSYSKILKDLKKEFCCNGTVVQDPELGQVIQLQGDQRKNVSTFLMQAGIVKKEYIKLHGF

SEQ ID NO: 438 - DNA, 339 bp, Glycine max
  CDS (1)..(339)
atggttgatttggaaatccaggtccccagcgcattcgacccgtttgccgaggcgagagaatcagatgcccccggggcaaaggagtatgtgcacatacgaattcagcagaggaatggaaagaagagtctgacaacagtgcaagggctgaagaaggagttcagctacgagaagatcctcaaggacctcaagaaggacttctgctgcaacgggactgtggtgcaggacaaggagcttggcaagattatccaactccaaggcgaccagcgcaagaacgtatcccatttcctcgttcaggccggtcttgtccggaaggaccaggtcaagattcatggtttttga

SEQ ID NO: 439 - protein, 112 aa, Glycine max
MVDLEIQVPSAFDPFAEARESDAPGAKEYVHIRIQQRNGKKSLTTVQGLKKEFSYEKILKDLKKDFCCNGTVVQDKELGKIIQLQGDQRKNVSHFLVQAGLVRKDQVKIHGF

SEQ ID NO: 440 - DNA, 501 bp, Glycine max
  CDS (1)..(501)
atgataaaagcagtgctggtgttgaacacggaggggaagcctcgtctcgccaaattctaccaatttcagtctgtggagaagcagcatgaagctattcgcaatgtgttttcagtcttatgctgtagacctgaacatgtcagcaattttgtggatgccgagtccttctttggcccggactctcgccttgtctacaagcactttgcaactttatatttcatgttcatatttgatagttctgaaaacgagcttgctatgcttgacttgatacaagtgtttgttgaaacattggacaaatgcttcagaaatgtatgtgagcttgatatcgtgttcaactatagtaagatgcataccatactagatgagatcattctcggaggccaggtgttggagacaagttcaaacgaggttatgaaggctattgaagaaatatcaaggcttgaatcagcatccaatgcaatcaaccttgttccaaaatctgtttctggttggaggtcacgataa

SEQ ID NO: 441 - protein, 166 aa, Glycine max
MIKAVLVLNTEGKPRLAKFYQFQSVEKQHEAIRNVFSVLCCRPEHVSNFVDAESFFGPDSRLVYKHFATLYFMFIFDSSENELAMLDLIQVFVETLDKCFRNVCELDIVFNYSKMHTILDEIILGGQVLETSSNEVMKAIEEISRLESASNAINLVPKSVSGWRSR

SEQ ID NO: 442 - DNA, 345 bp, Glycine max
  CDS (1)..(345)
atggttgaagtgggtatttatcagatccctacgagcactttcgacccatttgcggaggcaaaagaaacagatgctcccggggcaaaagagtatgtgcatatccgcatacaacagaggaatgggaagaagagtctgaccacagtgcaagggctgaagaaagagttcagctacgagaagatcctcaaagacctcaagaaagagttctgctgcaatggcaatgttgtgcatgacaaggagcttggcaagattatccaactccagggtgatcagcgcaagaacgtttctcacttcctcattcatgctcgccttgttaggaaggaccagatcaagattcatggtttttaa

SEQ ID NO: 443 - protein, 114 aa, Glycine max
MVEVGIYQIPTSTFDPFAEAKETDAPGAKEYVHIRIQQRNGKKSLTTVQGLKKEFSYEKILKDLKKEFCCNGNVVHDKELGKIIQLQGDQRKNVSHFLIHARLVRKDQIKIHGF

SEQ ID NO: 444 - DNA, 342 bp, Glycine max
  CDS (1)..(342)
atgtctgaattagacgatcaaattcctactgccttcgatccttttgctgatgcaaatgctgatgactcgggtgctgggtcaaaggagtatgtgcatattcgcgtacagcagcgaaatggaaggaaaagcctgacaaccgttcagggattgaaaaaagaattcagctataacaagatacttaaagatgttaagaaagagttctgttgcaatggaacagttgttcaggacccagaactaggacaggttattcaacttcaaggtgatcagaggaagaatgtttctaccttcctggtccaggctggtatcgtgaagaaggagcatatcaagattcatggtttctga

SEQ ID NO: 445 - protein, 113 aa, Glycine max
MSELDDQIPTAFDPFADANADDSGAGSKEYVHIRVQQRNGRKSLTTVQGLKKEFSYNKILKDVKKEFCCNGTVVQDPELGQVIQLQGDQRKNVSTFLVQAGIVKKEHIKIHGF

SEQ ID NO: 446 - DNA, 1503 bp, Glycine max
  CDS (1)..(1503)
atgtcgctgcctgcttgtcccgccgaacaactggcccaacttctcggcccaaacaccacagacgcctccgccgccgcctcccttatctgcggccagttcgccgccgtggacagcaagttcgtcgacacggccttcgccgtcgacaacacctacctcctcttttccgcctacctcgttttttctatgcagctcggcttcgccatgctctgcgccggctccgtccgcgccaagaacaccatgaacatcatgctcaccaacgtcctggacgctgccgccggcggcctcttctactacctcttcggcttcgccttcgctttcggctccccctccaacggcttcatcggtaaacatttcttcggcctcaaggacatcccttcatcctcctacgactacagctacttcctctaccaatgggccttcgccatcgccgccgccggcatcaccagcggaagcatcgccgaacgcacacagttcgtggcctatctcatctactcctccttcctcaccggcttcgtctatccggtggtctcccactggttctggtccccagacggctgggcctctgcctttaagatcaccgaccggctattttccaccggcgtaatagacttcgccggttccggcgtagtccacatggtcggcggaatagccggcctatggggagcgctgatcgaaggcccaagaatgggacgtttcgatcatgcaggacgagctgtggccttgcgaggccacagcgcgtccttagtagtcctgggaaccttcttgctttggttcggttggtacggatttaaccccggttcatttaacaaaatcctacttacttacggtaactcaggaaattactacggtcaatggagcgcggttggcagaaccgcggtcaccactaccctagcggggtcaacagctgccttgaccacgctattcggtaaacgggtgatatccggtcactggaacgtgaccgatgtctgcaacgggctgttaggcggtttcgcggcgataacagccggttgctccgtggttgagccatgggcagccatcgtatgcggttttgttgcttctatagtattaatagcttgcaacaaattagcagagaaggttaagttcgacgatcctctggaggcggcgcagttgcacggtgggtgtggcacgtggggggtgatattcacggcgttgttcgcaaaaaaggagtatgtgaaggaggtttacgggttggggagggcgcacgggttgctcatggggggtggtgggaagttgctggcggcgcacgtgattcagattctggtgattgctgggtgggttagtgcgaccatgggacccttgttttgggggttgaataaactgaagctgttgaggatttcttcagaggatgagcttgcggggatggacatgactcgccatggaggctttgcttatgcttatgaggatgatgagacgcacaagcatgggatgcagttgaggagggttgggcccaacgcgtcttccacacccaccactgatgaatga

SEQ ID NO: 447 - protein, 500 aa, Glycine max
MSLPACPAEQLAQLLGPNTTDASAAASLICGQFAAVDSKFVDTAFAVDNTYLLFSAYLVFSMQLGFAMLCAGSVRAKNTMNIMLTNVLDAAAGGLFYYLFGFAFAFGSPSNGFIGKHFFGLKDIPSSSYDYSYFLYQWAFAIAAAGITSGSIAERTQFVAYLIYSSFLTGFVYPVVSHWFWSPDGWASAFKITDRLFSTGVIDFAGSGVVHMVGGIAGLWGALIEGPRMGRFDHAGRAVALRGHSASLVVLGTFLLWFGWYGFNPGSFNKILLTYGNSGNYYGQWSAVGRTAVTTTLAGSTAALTTLFGKRVISGHWNVTDVCNGLLGGFAAITAGCSVVEPWAAIVCGFVASIVLIACNKLAEKVKFDDPLEAAQLHGGCGTWGVIFTALFAKKEYVKEVYGLGRAHGLLMGGGGKLLAAHVIQILVIAGWVSATMGPLFWGLNKLKLLRISSEDELAGMDMTRHGGFAYAYEDDETHKHGMQLRRVGPNASSTPTTDE

SEQ ID NO: 448 - DNA, 342 bp, Glycine max
  CDS (1)..(342)
atgtctgaattagacgatcaaattcctactgccttcgatccttttgctgatgcaaatgctgatgactcgggtgctgggtcaaaggagtatgtgcatattcgtgtacagcagcgaaatggtaggaaaagcctgacaaccgttcagggattgaaaaaggaattcagctataacaagatacttaaagacgtcaagaaagagttctgttgcaatggaacagttgttcaggacccagaactaggacaggttattcaacttcaaggtgatcagaggaagaatgtttctaccttcctagtccaggctggtatcgtgaagaaggatcatatcaagattcatggtttctga

SEQ ID NO: 449 - protein, 113 aa, Glycine max
MSELDDQIPTAFDPFADANADDSGAGSKEYVHIRVQQRNGRKSLTTVQGLKKEFSYNKILKDVKKEFCCNGTVVQDPELGQVIQLQGDQRKNVSTFLVQAGIVKKDHIKIHGF

SEQ ID NO: 450 - DNA, 501 bp, Glycine max
  CDS (1)..(501)
atgaagaatgcaaagggcaagggagcagcaagggcctcaaaagaatcactgaagcccgttgatgaccgaaaggttggaaagcggaaggcttccggtaagcctgggagaagtagtgcaccaaagaaggagaagaaggccaagaaagaccccaacaagcctaaaagaccacccagtgctttctttgtgttccttgaggagttcaggaagacctttaaggctgagaatcctaatgtgaaggctgtatcagttgttgggaaagctggaggagagaaatggaaatccttgtccagtgctgagaaagctccatatgaagccaaggctgcgaaaaggaaagctgagtatgaaaaacttatcaaagcttatgataaaaagcaggcaagctccgcagatgatgaagaatcagacaagtccaaatctgaagtgaatgatgaagatgatgccagtggagaggaggaggaagaggatgatgaggaggaagaggacgatgaagatgatgactga

SEQ ID NO: 451 - protein, 166 aa, Glycine max
MKNAKGKGAARASKESLKPVDDRKVGKRKASGKPGRSSAPKKEKKAKKDPNKPKRPPSAFFVFLEEFRKTFKAENPNVKAVSVVGKAGGEKWKSLSSAEKAPYEAKAAKRKAEYEKLIKAYDKKQASSADDEESDKSKSEVNDEDDASGEEEEEDDEEEEDDEDDD

SEQ ID NO: 452 - DNA, 342 bp, Glycine max
  CDS (1)..(342)
atgtctggattagacgatcaaattcctactgccttcgatccttttgctgatgcaaatgctgatgactcgggtgctgggtcaaaggagtatgtgcatattcgcgttcagcagcgaaatggtaggaaaagcctgacaaccgttcagggattgaaaaaagaattcagctataacaagatacttaaagacgttaagaaagagttctgttgcaatggaacagttgttcaggacccagaactaggacaggttattcaacttcaaggtgatcagaggaagaatgtttctactttcctagtacaggctggtatcgtgaagaaggatcatatcaagattcatggtttctga

SEQ ID NO: 453 - protein, 113 aa, Glycine max
MSGLDDQIPTAFDPFADANADDSGAGSKEYVHIRVQQRNGRKSLTTVQGLKKEFSYNKILKDVKKEFCCNGTVVQDPELGQVIQLQGDQRKNVSTFLVQAGIVKKDHIKIHGF

SEQ ID NO: 454 - DNA, 1086 bp, Glycine max
  CDS (1)..(1086)
atggctcagaccacagcgaatcacacagtgaccgtatctgggtgggcagctcatgattcttcgggcaagattaccccctacactttcaaaagaagggagaatggtgtgaacgatgtgacaataaagatactgtattgtgggatctgccacacggacctccactatgctaaaaatgaatggggcattactatgtatcctgtagtacccggacacgagatcattggggtggtaactaaggtggggagagacgtgaaggggttcaaggaaggagacagagtgggtgtggggtgtttggcggcttcatgtttggaatgtgagcactgcaagaccgatcaggaaaattactgtgaaaagttgcaatttgtctacaacggagtattctgggatggcagcatcacctatgggggctactctcaaatttttgtcgcagattacagatatgtggtacacattccggaaaacctagcaatggatgcagcggctcctctgctatgcgcaggaataacagtgttcaatcctttgaaagaccacgatttggtagcatcaccgggaaagaagattggggtggttggtctgggaggccttgggcacattgccgttaaatttggcaaggctttcggccaccatgttaccgtcatcagcacttctccctccaaggaggctgaagctaagcagcgtttgggtgctgatgatttcattgtcagctccaaccctaaacaattacaggctgcaaggagaagcatagatttcatattggacactgtttcggcagagcactctctgttgcccatcttggaattgctcaaagtcaacgggaccttatttctcgtgggtgcaccagacaagcccttacaattgccagctttcccattgatatttggcaagagatcagtgaaaggtgggatcatagggggaataaaagagacgcaggaaatgttggaggtttgtgcaaagtacaatataacgagtgacattgaattaatcacaccagacagaatcaacgaggctatggagcgccttgctaagaatgatgtgcgctaccgtttcgtcattgatattgctaatgctgccgcttccaacaactaa

SEQ ID NO: 455 - protein, 361 aa, Glycine max
MAQTTANHTVTVSGWAAHDSSGKITPYTFKRRENGVNDVTIKILYCGICHTDLHYAKNEWGITMYPVVPGHEIIGVVTKVGRDVKGFKEGDRVGVGCLAASCLECEHCKTDQENYCEKLQFVYNGVFWDGSITYGGYSQIFVADYRYVVHIPENLAMDAAAPLLCAGITVFNPLKDHDLVASPGKKIGVVGLGGLGHIAVKFGKAFGHHVTVISTSPSKEAEAKQRLGADDFIVSSNPKQLQAARRSIDFILDTVSAEHSLLPILELLKVNGTLFLVGAPDKPLQLPAFPLIFGKRSVKGGIIGGIKETQEMLEVCAKYNITSDIELITPDRINEAMERLAKNDVRYRFVIDIANAAASNN

SEQ ID NO: 456 - DNA, 1659 bp, Glycine max
  CDS (1)..(1659)
atggcatcaactactctcttcagcttcagactctctttgaacccactgcaccatcaacagacaacgaggccaaaatctctgctctcctctcctcgcaccaatccacgcctcgtttcttccattaacaatcatttggccctcacacgtgtcacatacccgcttctccaatctcactctgctcctaagcgcagattccatgtgtattctgatggggaaagctccgagtcgcttgtttctgacgctacataccaagaggaattttcttggtcttctgtaattcttccgtttctgttccctgcgttgggtggcttattatttggctatgatattggagccacctctggcgctacaatttcactgcagtcacctgagcttagcggtatatcatggtttaaactttctgctattcagcttggactagtggttagtggttccctatatggggctcttcttggctcgcttgttgcatttgccatagctgatttccttgggaggaagaaacaactcattactgcagcactgttgtatttgtttggtggtgtgattactgcctatgcaccagaacttggtgttctcttagcaggaaggctgctttatggacttggtataggtttggccatgcatggggctcctttatatattgcggagacttgtccatcacaaatccgtgggactttagtatcattaaaagaactcttcattgtcctggggattctgctgggttattttgtgggaagctttctgattgagaccgttgggggatggcggttcatgtatggatttagtgctccagttgctgtattaatggggcttggaatgttgactctccccaattctccacggtggttgcttctcagagcagtgcaaggaaaaggttcttttcaagatttgaaggaaaaggccattttttccctgagcaaattaaggggccgaccacctggtgacaaagaatccgagagacaagtagaagaaacccttgtctcattgaagtctgcctatgcagataaggaatcggaggggaatttcttagaggtgtttcagggtccgaatctgaaagctttcataattggtgggggactagtcttatttcaacagataacaggtcaaccaagtgttctgtactatgcaggtccaattcttcagagtgctggattttctgctgcatccgatgctacaaaagtttcggttgttattggcctattcaagttgctaatgacttggattgctgtcctaaaagttgatgatttggggagaagacctctgctgattggaggtgtcagtggcattgccctttctctagttctcctttctgcttattataaatttcttggaggtttcccacttgttgctgttggagctttacttctttatgttggttgctaccagatatcatttgggccgataagttggctaatggtatcagaggtcttcccacttcgcactagaggaaaggggattagtctggctgttcttaccaacttcgcttcaaatgctgttgtcacctttgcattctccccgctaaaggagtttctaggagcagaaaatctttttctcctttttggggctattgctattctatcacttttgttcattatcttttctgtcccagagacaaaaggcttgagtttagaagatatagaatccaaaatcttgaagtga

SEQ ID NO: 457 - protein, 552 aa, Glycine max
MASTTLFSFRLSLNPLHHQQTTRPKSLLSSPRTNPRLVSSINNHLALTRVTYPLLQSHSAPKRRFHVYSDGESSESLVSDATYQEEFSWSSVILPFLFPALGGLLFGYDIGATSGATISLQSPELSGISWFKLSAIQLGLVVSGSLYGALLGSLVAFAIADFLGRKKQLITAALLYLFGGVITAYAPELGVLLAGRLLYGLGIGLAMHGAPLYIAETCPSQIRGTLVSLKELFIVLGILLGYFVGSFLIETVGGWRFMYGFSAPVAVLMGLGMLTLPNSPRWLLLRAVQGKGSFQDLKEKAIFSLSKLRGRPPGDKESERQVEETLVSLKSAYADKESEGNFLEVFQGPNLKAFIIGGGLVLFQQITGQPSVLYYAGPILQSAGFSAASDATKVSVVIGLFKLLMTWIAVLKVDDLGRRPLLIGGVSGIALSLVLLSAYYKFLGGFPLVAVGALLLYVGCYQISFGPISWLMVSEVFPLRTRGKGISLAVLTNFASNAVVTFAFSPLKEFLGAENLFLLFGAIAILSLLFIIFSVPETKGLSLEDIESKILK

SEQ ID NO: 458 - DNA, 1452 bp, Glycine max
  CDS (1)..(1452)
atgtgggtgggacattcatctatgtacaagcgcactccttcgagagataattcaaacatggaggacatggaagaaaactcagacatcggcctggacaagggaacatcaaatccttcattgatgctttctttaccgcatgtacttgtggcgaccatttcttcattcctttttggataccatctgggggttgttaatgaaccacttgagagcatttctgtggatcttggcttccgtggaaatacattggcagaaggtctggtggtgagcatatgccttggtggtgccttgattggatgtctactaagtggttggattgctgatggggtggggcgtcgtagggctttccagttgtgtgctctgccaatgataattggtgcttctatgagtgcagcaacaaacaacttgtttggcatgcttgtaggaaggttgtttgttgggactggcttgggcctgggccctcctgttgcctctctgtatgtgacagaggtttctcctgcttttgtgcggggcacctttggagctttcatccagattgcaacatgccttggtctaatgggagctttatttattggaatccctgtcaaagaaatttctggatggtggcgggtttgtttttgggtatctaccattccagctgctatacttgccgcagctatggtcttctgcgcagagagtccgcattggttatacaagcaaggaagaactgctgaagcagaagctgagtttgagagacttctgggtgtatcagaagcaaaatttgcaatgtcggagttatccaaggtagatagaagtgatgatactgatactgtaaagctgtcggaattgcttcatggtcgtcattctaaagttgtttttattggatcaaccctatttgctttacaacagctatctggtataaatgctgggttttatttctcttcaactgtttttaaaagtgctggagtcccatcagacattgcaaatgtctgcataggaatcgctaatttggcaggatctatcgtttcaatgggtttgatggataagcttggaaggaaggttctacttttctggagtttctttggcatggcaatagcaatgatccttcaagccacaggagcaacttcacttgtatcaaacgtgggagctcagtacttttctgttggtggcatgttactgtttgtcttaacatttgctctgggggctggtccagttccaggtctccttctaccagaaatctttcctagtcgaataagagccaaagccatggcagtctgtatgtcagtgcattgggtgataaatttctttgttggactactgttcttgcgtttgctggagaaacttggtccacagctgctttactccatgtttgctaccttttgcatcatggcagtaacttttgtaaaaagaaatgtggtggaaaccaaagggaagtcacttcatgaaattgagatcgcacttcttcctcaagactag

SEQ ID NO: 459 - protein, 483 aa, Glycine max
MWVGHSSMYKRTPSRDNSNMEDMEENSDIGLDKGTSNPSLMLSLPHVLVATISSFLFGYHLGVVNEPLESISVDLGFRGNTLAEGLVVSICLGGALIGCLLSGWIADGVGRRRAFQLCALPMIIGASMSAATNNLFGMLVGRLFVGTGLGLGPPVASLYVTEVSPAFVRGTFGAFIQIATCLGLMGALFIGIPVKEISGWWRVCFWVSTIPAAILAAAMVFCAESPHWLYKQGRTAEAEAEFERLLGVSEAKFAMSELSKVDRSDDTDTVKLSELLHGRHSKVVFIGSTLFALQQLSGINAGFYFSSTVFKSAGVPSDIANVCIGIANLAGSIVSMGLMDKLGRKVLLFWSFFGMAIAMILQATGATSLVSNVGAQYFSVGGMLLFVLTFALGAGPVPGLLLPEIFPSRIRAKAMAVCMSVHWVINFFVGLLFLRLLEKLGPQLLYSMFATFCIMAVTFVKRNVVETKGKSLHEIEIALLPQD

SEQ ID NO: 460 - DNA, 1080 bp, Glycine max
  CDS (1)..(1080)
atggcagcacaagctgaaattgagcatcctaggaaagcattcggatgggcagctagggattcttccggtcttctctcccctttcaatttctgcagaagggaacccggtgagaaagatgtggcattcagagtgttgtactgtgggatatgccactcggacctccacagcataaagaacgaatggggtacttccatctatccaatggttcctgggcatgaggtagctggtgtagtaacagaggtgggaagcaaagtagagaagttcaaagttggggacaaggttggtgtgggatgcctggttgattcctgccgcacctgccaaaactgttgcgacaatcttgagaattattgtcctcaatctacgttcacatatggtgccaaatatagagatggaaccatcacatatggaggctactctgactcaatggttgctgatgagcattttgtggttcgcattccagatagattaccacttgatgctgctgcacctcttctttgtgctggcatcactgtgtatagccctctcagatattatggacttgacaagcctggtctgcatgtgggtgtggttggtcttggtggactaggccatatggctgtcaagtttgccaaagcttttggtgctaaggtcacagtaataagtacttcaccaaacaaaaaggaagaagcaatacaaaatcttggagctgattcttttctaataagccgggaccaagatcagatgcaggctgcaatgggtactttggatggtattattgacacagtttctgccgttcatcctctcttacctctcattggtttgctcaagtctcatggaaagcttgtaatggttggtgcaccggagaagcctctggaactgcctgtttttcctttacttgcggggagaaagatagttgctggcactctgattggagggctaatggagacgcaagaaatgattgattttgcagcgaaacacaatgtgaaacctgacattgaagtcattcctatggactatgtcaacacagcaatggagcgcctccttaaagcagatgttaaatatcgatttgttattgatattggaaacacactgaaattctga

SEQ ID NO: 461 - protein, 359 aa, Glycine max
MAAQAEIEHPRKAFGWAARDSSGLLSPFNFCRREPGEKDVAFRVLYCGICHSDLHSIKNEWGTSIYPMVPGHEVAGVVTEVGSKVEKFKVGDKVGVGCLVDSCRTCQNCCDNLENYCPQSTFTYGAKYRDGTITYGGYSDSMVADEHFVVRIPDRLPLDAAAPLLCAGITVYSPLRYYGLDKPGLHVGVVGLGGLGHMAVKFAKAFGAKVTVISTSPNKKEEAIQNLGADSFLISRDQDQMQAAMGTLDGIIDTVSAVHPLLPLIGLLKSHGKLVMVGAPEKPLELPVFPLLAGRKIVAGTLIGGLMETQEMIDFAAKHNVKPDIEVIPMDYVNTAMERLLKADVKYRFVIDIGNTLKF

SEQ ID NO: 462 - DNA, 645 bp, Oryza sativa
  CDS (1)..(645)
atgagcggcgccaccaagttcatcaagtgcgtcaccgtcggcgacggcgccgtcggcaagacctgcatgctcatctgctacatcagcaacaagttccccaccgattacatccccaccgtgttcgacaacttcagtgctaatgtttcagtggatgggaacatcgtcaacttgggattatgggacactgctggacaagaggattacagcaggctgaggccactgagctacaggggagcggatatatttgtgctggcattctcactgatcagcagagcaagctatgagaatgttctcaagaagtggatgccggagcttcgccggttcgcaccgaatgttccaattgttcttgttgggaccaagttagatctacgtgaccacagatcttaccttgcggaccatcctgctgcttccgcaattacgactgcacagggtgaagaacttagaaagcagataggcgccgcggcttacatcgaatgcagttcgaaaacacaacagaacatcaaggccgtgtttgatactgccatcaaggtggtccttcagcctcctcggagaaggggggagacgacgatggcaaggaagaagacaaggcgaagcaccggctgctcgttaaagaacttgatgtgtggcagtgcatgtgttgtttag

SEQ ID NO: 463 - protein, 214 aa, Oryza sativa
MSGATKFIKCVTVGDGAVGKTCMLICYISNKFPTDYIPTVFDNFSANVSVDGNIVNLGLWDTAGQEDYSRLRPLSYRGADIFVLAFSLISRASYENVLKKWMPELRRFAPNVPIVLVGTKLDLRDHRSYLADHPAASAITTAQGEELRKQIGAAAYIECSSKTQQNIKAVFDTAIKVVLQPPRRRGETTMARKKTRRSTGCSLKNLMCGSACVV

SEQ ID NO: 464 - DNA, 786 bp, Oryza sativa
  CDS (1)..(786)
atggccgtgggcaagaacaagaggatctccaagggcaggaagggcagcaagaagaagaccgtcgatcccttttccaagaaggattggtacgacatcaaggcgccgaccgtgttctccgtccgcaacatcggcaagaccctcgtctccaggacccaggggaccaagattgcatctgagggtctcaagcatcgtgtctttgaagtctccttggcggatcttcagaatgacgaggatcaggcttacaggaaggttagacttcgtgctgaggatgttcaggggaggaatgtcctcacgaatttctggggcatgagttttaccacggacaaacttaggtccttggtcaagaaatggcaaacattgattgaagcccatgtggatgttaagaccacagataactacatgctccgcctgttttgcattggtttcaccaagcgccgcccaaatcaggtgaagcgtacctgttacgctcaggctagccagatccggcagatccgccggaagatggttgagatcatggccaaccaggcatcaacatgtgacttgaaagaactggtttcaaaattcatccctgaagtcattggaaaggagatcgagaagtcaacttcaagtatattccctctccaaaatgtgttcatccgcaaggtgaagatcttgaaggcaccgaagtttgatcttgggaagttgatggaggtacacggtgactacaaggaagatgtcggtatgaagctggacaggcctgctgagactgacgaggcggtggcaggggaggttgcagcagctgagtag

SEQ ID NO: 465 - protein, 261 aa, Oryza sativa
MAVGKNKRISKGRKGSKKKTVDPFSKKDWYDIKAPTVFSVRNIGKTLVSRTQGTKIASEGLKHRVFEVSLADLQNDEDQAYRKVRLRAEDVQGRNVLTNFWGMSFTTDKLRSLVKKWQTLIEAHVDVKTTDNYMLRLFCIGFTKRRPNQVKRTCYAQASQIRQIRRKMVEIMANQASTCDLKELVSKFIPEVIGKEIEKSTSSIFPLQNVFIRKVKILKAPKFDLGKLMEVHGDYKEDVGMKLDRPAETDEAVAGEVAAAE

SEQ ID NO: 466 - DNA, 411 bp, Oryza sativa
  CDS (1)..(411)
atggctcgtactaagcaaactgctcgcaagtcaactggaggaaaggctcccaggaagcaacttgccaccaaggctgctcgtaagtctgctcccacaactggaggagtgaagaagcctcaccgttaccgccctggaactgttgctcttcgtgaaatccgcaagtaccagaagagcactgagctgctcataaggaagcttccattccagaggcttgttagggagattgcccaggattttaagactgatcttcgtttccagagccatgcggtgcttgcccttcaggaagctgccgaggcgtacctggtgggtctcttcgaggacaccaacctgtgcgccatccatgccaagcgtgtgaccatcatgcccaaggacattcagctggctaggaggatccgtggtgagagggcttag

SEQ ID NO: 467 - protein, 136 aa, Oryza sativa; identical to SEQ ID NO: 298

SEQ ID NO: 468 - DNA, 741 bp, Oryza sativa
  CDS (1)..(741)
atggacgcctctctcatgggcgccccctccgccgcagcgggagacaatcccacctccggggagcaccggatggggaccaccatcgtcggcgtctgctacgacggcggcgtcgtcctcgccgccgattccagaaccagcaccggaatgtatgtggcaaaccgtgcgtcggacaagattactcagctaactgacaatgtgtacatctgccgctctggatctgctgctgatacacaagtaatttccgattatgtacgctattttctccaccaacacacaattcagcttgggcagccagctaccgtgaaagttgcagccaacttaattaggttgttggcttatcagaacaagaacatgttgcaagctggcatgattgttggtggatgggataaatatgagggaggccaaattttctcagtcccccttggtggaacaattctgaggcaaccatttgcaatcggaggttcaggctctagttacctctatggattgcttgaccacgaatggaaggagggcatgtcccaggaagaagctgagaagtttgtggttaaggtagtttcccttgctatagcccgtgatggtgctagtggaggggttgttcgtaccgtcactataaacgcagatggtgtttcgaggaaatttcaccctggagacaaactacaactgtggcatgaagagctggagccccagaactcgttgctggacatacttgcagctgggaaccctgatccgatggtccaatga

SEQ ID NO: 469 - protein, 246 aa, Oryza sativa
MDASLMGAPSAAAGDNPTSGEHRMGTTIVGVCYDGGVVLAADSRTSTGMYVANRASDKITQLTDNVYICRSGSAADTQVISDYVRYFLHQHTIQLGQPATVKVAANLIRLLAYQNKNMLQAGMIVGGWDKYEGGQIFSVPLGGTILRQPFAIGGSGSSYLYGLLDHEWKEGMSQEEAEKFVVKVVSLAIARDGASGGVVRTVTINADGVSRKFHPGDKLQLWHEELEPQNSLLDILAAGNPDPMVQ

SEQ ID NO: 470 - DNA, 543 bp, Oryza sativa
  CDS (1)..(543)
atgggattcatcggcgatacggtggagtcgatccgctcgatacagatccgccaagtcctcgcgcaaatcatcagcctcggtatgattgttacctcggcactgatcatatggaagggattgatggttgcaacggggagcgagtccccagtggttgtggtcctttctggtagcatggagcctggatttaaaaggggcgatatcctttttctacacatgagcaaagatcctatccgcacaggagagatagttgttttcaacattgatggccgtgaaattccaattgttcaccgtgtgattaaggtccatgaacgcgaggaaagtgctgaagttgatatcctcacgaaaggtgataataattttggggacgaccgtcttctttatgcacatgggcagctttggcttcaccaacatcacattatgggacgggctgtaggctttcttccatatgtcgggtgggttacaatcatcatgactgagaaaccatttataaagtacctgctcatcggcgctctgggcttgctggtcattacatcgaaagagtaa

SEQ ID NO: 471 - protein, 180 aa, Oryza sativa
MGFIGDTVESIRSIQIRQVLAQIISLGMIVTSALIIWKGLMVATGSESPVVVVLSGSMEPGFKRGDILFLHMSKDPIRTGEIVVFNIDGREIPIVHRVIKVHEREESAEVDILTKGDNNFGDDRLLYAHGQLWLHQHHIMGRAVGFLPYVGWVTIIMTEKPFIKYLLIGALGLLVITSKE

SEQ ID NO: 472 - DNA, 543 bp, Oryza sativa; identical to SEQ ID NO: 470
  CDS (1)..(543)

SEQ ID NO: 473 - protein, 180 aa, Oryza sativa; identical to SEQ ID NO: 471

SEQ ID NO: 474 - DNA, 600 bp, Oryza sativa
  CDS (1)..(600)
atgggttgctcctcctccgtgccagctcgaagcactggagggttgaacaatattagcaacgataactccgctactgattcaaaggacttgcgtgctaagttggtattgcttggtgactctggtgtagggaaaagttgcattgttcttcgctttgttcgtggtcagtttgatcccacttccaaggtaactgtcggtgcatcatttttatcacaaacattggctttggaggactcaacaatagtgaaatttgaaatatgggataccgctggacaagagaggtatgctgccttggcacctctttactacagaggagctgctgctgcagttgttgtctacgacataactagtccagaatcatttagcaaagcacaatactgggtgaaggaacttcaaaaacatggtagtcctgatattatcatggttttggttggtaataaagctgatctacatgaaaatcgacatgtatcttctcaggaagcacaagagtatgcagagaagaataatatggttttcatcgagacatcagcaaagacagctgataatataaaccaagtatttgaggaaattgcgaagaggttgcccaggccaacggcgtcttga

SEQ ID NO: 475 - protein, 199 aa, Oryza sativa
MGCSSSVPARSTGGLNNISNDNSATDSKDLRAKLVLLGDSGVGKSCIVLRFVRGQFDPTSKVTVGASFLSQTLALEDSTIVKFEIWDTAGQERYAALAPLYYRGAAAAVVVYDITSPESFSKAQYWVKELQKHGSPDIIMVLVGNKADLHENRHVSSQEAQEYAEKNNMVFIETSAKTADNINQVFEEIAKRLPRPTAS

SEQ ID NO: 476 - DNA, 348 bp, Oryza sativa
  CDS (1)..(348)
atgtctgatctcgacgtccagcttccatcagcttttgatccgtttgcggaagccaatgctgaggactccagcgttggtgctggatcaaaggactatgtacacgtgcgcattcagcagcgcaacggaagaaagagtctgactactgttcagggcttgaagaaagagtacagttacaacaaaatcctcaaggatctgaaaaaggaattctgttgtaatggtactgtagtccaagatccagagttaggccaggtcattcaacttcaaggtgatcagcgtaaaaatgttgcgacgttcctagttcaggctggaattgtaaagaaagagagcatcaaaatacacgggttttag

SEQ ID NO: 477 - protein, 115 aa, Oryza sativa
MSDLDVQLPSAFDPFAEANAEDSSVGAGSKDYVHVRIQQRNGRKSLTTVQGLKKEYSYNKILKDLKKEFCCNGTVVQDPELGQVIQLQGDQRKNVATFLVQAGIVKKESIKIHGF

SEQ ID NO: 478 - DNA, 768 bp, Oryza sativa
  CDS (1)..(768)
atggcggtcgtcggcgtcctcgcgctgcagggctccttcaacgagcacttggccgcgctgaggaggatcggggtgaggggggtggaggtgcggaagccggagcagctgcaggggctcgactcgctcatcatccccggcggcgagagcaccaccatggccaaactcgccaactaccacaacctgtttcctgcacttcgagaatttgttggtacaggaaggcctgtctggggaacttgtgctggactcatcttcctagctaacaaggcagtaggccaaaaatccggaggtcaggagcttattggaggactagattgtactgtccaccggaacttttttgggagccagcttcaaagctttgaaacggaactttcagtgccaatgcttgcagagaaggaaggagggagcgatacatgccgtggcgtatttatacgagcacctgctatcttggatgtaggttcaaatgttgaagtactggcggattgtcctgttccatcggatagacccagtattacaatagcgtctggagagggtgttgaggaagaagtgtactcgaaagatcgggtaattgttgctgtaaggcaagggaacatcctcgctactgcttttcacccagaattgacatcagactctagatggcatcggttcttcctggacatggataaagaatctgatacaaaagccttctctgctctctctctctcatcatcttcaagagacactcaagatgggtcaaagaataagcctcttgatctacccatcttcgagtag

SEQ ID NO: 479 - protein, 255 aa, Oryza sativa
MAVVGVLALQGSFNEHLAALRRIGVRGVEVRKPEQLQGLDSLIIPGGESTTMAKLANYHNLFPALREFVGTGRPVWGTCAGLIFLANKAVGQKSGGQELIGGLDCTVHRNFFGSQLQSFETELSVPMLAEKEGGSDTCRGVFIRAPAILDVGSNVEVLADCPVPSDRPSITIASGEGVEEEVYSKDRVIVAVRQGNILATAFHPELTSDSRWHRFFLDMDKESDTKAFSALSLSSSSRDTQDGSKNKPLDLPIFE

SEQ ID NO: 480 - DNA, 783 bp, Oryza sativa
  CDS (1)..(783)
atggccgtcggcaagaacaagcggatctcgaaggggaagaagggatccaagaagaagaccgtcgatccttttgcgaagaaggattggtatgatatcaaggccccgtcggtgttcaacgtgagaaacgtcgggaagacgctcgtgtccaggacacagggcacaaagattgcttcagagggcctcaagcaccgtgtgtttgaggtctccttggctgatcttcagaacgatgaggatcaggcgtaccgtaagatcagactacgtgccgaggatgtgcaggggaaaaatgttcttacaaacttctggggcatgagtttcacgaccgacaagctcagatcattggtcaagaaatggcagacgctaatagaggctcatgtggatgtaaagaccactgataactacatgctgcgtctcttctgcattggcttcaccaagaggaggccaaatcaagtcaaacggacatgctatgctcaagcaagccagattcgacagatccgtcgcaagatggtggagatcatggtgaaccaggcatcatcctgtgatctcaaggagctggtgtcaaaattcattcctgaggtgattgggaaggaaatcgagaaggccacatcaagcatcttcccgcttcagaatgtgtttgtgcgcaaagtcaagatcctcaaggccccaaaatttgacctgggcaagcttatggaggttcatggagattacaaggaggacgttgggacgaagctcgagaggcctgcagaagatgaggtcgtggtaggacaggaggtcactgccgagtag

SEQ ID NO: 481 - protein, 260 aa, Oryza sativa
MAVGKNKRISKGKKGSKKKTVDPFAKKDWYDIKAPSVFNVRNVGKTLVSRTQGTKIASEGLKHRVFEVSLADLQNDEDQAYRKIRLRAEDVQGKNVLTNFWGMSFTTDKLRSLVKKWQTLIEAHVDVKTTDNYMLRLFCIGFTKRRPNQVKRTCYAQASQIRQIRRKMVEIMVNQASSCDLKELVSKFIPEVIGKEIEKATSSIFPLQNVFVRKVKILKAPKFDLGKLMEVHGDYKEDVGTKLERPAEDEVVVGQEVTAE

SEQ ID NO: 482 - DNA, 297 bp, Oryza sativa
  CDS (1)..(297)
atggcgaggcggctgatcccgtcgctgaaccgcgtgctggtggagaagctggtgcagcccaagaagagcgccggcggcatcctcctccctgagacgtccaagcagctcaactctggtaaagtggtggctgttggccctggcgaacgtgacaaggatggcaagctgatccctgttgctctcaaggaaggagacactgttctcctgcctgaatatggtggactcgaagtcaagcttgctgctgaaaaagagtaccttctcttcagagagcatgacatcttgggcacccttgtggactga

SEQ ID NO: 483 - protein, 98 aa, Oryza sativa
MARRLIPSLNRVLVEKLVQPKKSAGGILLPETSKQLNSGKVVAVGPGERDKDGKLIPVALKEGDTVLLPEYGGLEVKLAAEKEYLLFREHDILGTLVD

SEQ ID NO: 484 - DNA, 429 bp, Oryza sativa
  CDS (1)..(429)
atgatccggttcatcctgctgcagaatcggcaggggaagacgcggctggccaagtactacgtcccgctcgaggactcggagaagcacaaggtcgagtacgaggtgcatcggctggtggtcaaccgggatcccaagttcaccaacttcgttgagttccggacgcataaagttatatacaggcgatatgcaggactgtttttctcaatgtgtgtggatatcactgacaatgagttggcatacttggaatgcatccacttgtttgtcgagatattagatcatttcttcagcaatgtgtgtgaactcgacttagtatttaatttccacaaggtttatttgatattggatgagtttattctcgctggagaacttcaagagacaagcaaaagggcaataatagagcgaatgggtgagcttgagaagctggaataa

SEQ ID NO: 485 - protein, 142 aa, Oryza sativa
MIRFILLQNRQGKTRLAKYYVPLEDSEKHKVEYEVHRLVVNRDPKFTNFVEFRTHKVIYRRYAGLFFSMCVDITDNELAYLECIHLFVEILDHFFSNVCELDLVFNFHKVYLILDEFILAGELQETSKRAIIERMGELEKLE

SEQ ID NO: 486 - DNA, 411 bp, Oryza sativa
  CDS (1)..(411)
atggcccgcacgaagcagacggcgcgcaagtccaccggcgggaaggcgccgaggaagcagctggcgaccaaggcggcgcgcaagtcggcgccggccaccggcggcgtgaagaagccgcaccgcttcaggccgggcaccgtcgcgctccgtgagatccgcaagtaccagaagagcacggagctgctcatccgcaagctccccttccagcgcctcgtccgcgagatcgcccaggacttcaagaccgacctccgcttccagagctccgccgtcgccgcgctgcaggaggccgcggaggcgtacctcgtcgggctcttcgaggacactaacctgtgcgccatccacgccaagcgcgtcaccatcatgcccaaggacatccagctcgcccgccgcatccgcggtgagcgcgcctga

SEQ ID NO: 487 - protein, 136 aa, Oryza sativa; identical to SEQ ID NO: 306

SEQ ID NO: 488 - DNA, 1005 bp, Oryza sativa
  CDS (1)..(1005)
atggtggattgccttgccatcttcggggcaggtgcgatgcttggggattcatttcttcatcaactgccacatgcctttggtggagggcattctcatacacatgatcatcagaatcataatcattctcatgagcattcacatgcacactctctggaagatctttctattggtttgtctgttctatttggcattgtgtttttctttattgttgagaagattgtgaggtatgtggaagacaattctcagaaaggggctcatggcatgggccaccatcatcaccatcataaacgacacgataggagcgacaaggccaagttgaatcacgcagaaaaggatcatgaggataaaggcgtaaatcaagcagaaaaggaaccttcgcatgatggtgcaattgagaaaacagatggtgtaactcgtgctgattcaaaatctgcaatccgtaagaggggcttatcttctggttccaattccgctgatagagagcctgtcaattctgaaagtgaccctgcccctaacaaagcattatcaagtgaagattcctctgtttccaattcgaatatggtgttcggctacctcaaccttttctcagatggtgttcataactttactgatgggatggccctagggagtgcttttctgctacatggttctgttggaggatggtcgagaactctatttctgcttgcacatgaacttcctcaagaggtcggagattttggtatcctggtgcgctcaggattcactgtaactaaagccctatttttcaattttctctctgcgttggttgctcttgctggaacagcactggcattgtctttgggaaaagatccagggcattcttctttgattgagggattcactgctggtggctttatttatattgctgttgctggagtcctcccagagatgaatgatcagaaaacaaccgtcaaaagctcgatgattcagttggtttccctgacaatgggaatgctggttgccctcggcatatctctagtagaatga

SEQ ID NO: 489 - protein, 334 aa, Oryza sativa
MVDCLAIFGAGAMLGDSFLHQLPHAFGGGHSHTHDHQNHNHSHEHSHAHSLEDLSIGLSVLFGIVFFFIVEKIVRYVEDNSQKGAHGMGHHHHHHKRHDRSDKAKLNHAEKDHEDKGVNQAEKEPSHDGAIEKTDGVTRADSKSAIRKRGLSSGSNSADREPVNSESDPAPNKALSSEDSSVSNSNMVFGYLNLFSDGVHNFTDGMALGSAFLLHGSVGGWSRTLFLLAHELPQEVGDFGILVRSGFTVTKALFFNFLSALVALAGTALALSLGKDPGHSSLIEGFTAGGFIYIAVAGVLPEMNDQKTTVKSSMIQLVSLTMGMLVALGISLVE

SEQ ID NO: 490 - DNA, 432 bp, Oryza sativa
  CDS (1)..(432)
atggggatccggttcgtgctgttcgtgaacaagcaggggcagacgcggctggcccagtactacgagcacctctccatcgacgagcgccgcgccctcgagggcgagatcgtccgcaagtgcctcgcccgcaccgaccagcagtgttcgttcgtggagcaccggaactacaaggtggtgtaccggcggtacgcttccctcttcttcctcgtcggcgtcgacaacgacgagaatgagctagctattctcgaattcattcatctttttgtggaaactatggaccgccacttcggaaatgtgtgtgaactcgacatcatgttccatctagagaaggtgcacttcatgctggaagagatggtgatgaatggctgcatagtagagacaagtaaacagaacatcttagcaccaatccagcttatggagaaaacttcttag

SEQ ID NO: 491 - protein, 143 aa, Oryza sativa
MGIRFVLFVNKQGQTRLAQYYEHLSIDERRALEGEIVRKCLARTDQQCSFVEHRNYKVVYRRYASLFFLVGVDNDENELAILEFIHLFVETMDRHFGNVCELDIMFHLEKVHFMLEEMVMNGCIVETSKQNILAPIQLMEKTS

SEQ ID NO: 492 - DNA, 486 bp, Oryza sativa
  CDS (1)..(486)
atgatcaatttcgtgctcctgatcagccgccagggcaaggtgaggcttaccaagtggtactcgccttacacccagaaggagaggactaaggttatccgtgagctcagtgggctcattctaacacgcgggccaaaactctgcaactttgttgagtggaagggttacaaggttgtgtacagaaggtatgcgagcctgtatttctgcatgtgcattgatgctgaggacaatgagctcgaggtccttgaaattatccatcacttcgttgaagtactggaccgatattttggcagcgtatgcgagctggatttgatattcaatttccacaaggcctactacatacttgatgaaattctcatcgctggtgagcttcaagaatctagcaagaaaaatgttgcaagactaattgctgcacaggattcattggtagaggcagctaaagaggaagctagctctataagcaacatcattgcccaggctacaaaataa

SEQ ID NO: 493 - protein, 161 aa, Oryza sativa
MINFVLLISRQGKVRLTKWYSPYTQKERTKVIRELSGLILTRGPKLCNFVEWKGYKVVYRRYASLYFCMCIDAEDNELEVLEIIHHFVEVLDRYFGSVCELDLIFNFHKAYYILDEILIAGELQESSKKNVARLIAAQDSLVEAAKEEASSISNIIAQATK

SEQ ID NO: 494 - DNA, 648 bp, Oryza sativa
  CDS (1)..(648)
atggcgtccagcgcgtcgcggttcatcaagtgcgtcacggtcggggacggcgccgtcggcaagacctgcatgctcatctgctacaccagcaacaagttccccactgattacgtacccactgtttttgacaatttcagtgcaaacgtggtggtcgacggcaccacggtgaatttgggtctctgggatactgcagggcaggaagattacaacagattgaggccgctaagctaccgtggcgccgatgtctttgtgcttgccttctccctagtgagccgagctagctatgagaatgtcatgaagaagtggttaccagagcttcagcattatgcaccaggggtgccaattgtgttggttgggaccaaattggatcttcgtgaagataaacactacttacttgaccatcctagcttggtgcctgtgactacagcacagggagaggaactccgcaagcacattggcgcaacgtgttacatcgaatgcagctcaaagacacagcagaatgtaaaagctgtgtttgatgctgccatcaaggtagtaatcaagcctccaacaaagcagagggacaggaagaagaagaaaacacggcgcggatgttctttcttctgcaagggtgtcatgtccagaagaaggctagtatgcttcaagtga

SEQ ID NO: 495 - protein, 215 aa, Oryza sativa
MASSASRFIKCVTVGDGAVGKTCMLICYTSNKFPTDYVPTVFDNFSANVVVDGTTVNLGLWDTAGQEDYNRLRPLSYRGADVFVLAFSLVSRASYENVMKKWLPELQHYAPGVPIVLVGTKLDLREDKHYLLDHPSLVPVTTAQGEELRKHIGATCYIECSSKTQQNVKAVFDAAIKVVIKPPTKQRDRKKKKTRRGCSFFCKGVMSRRRLVCFK

SEQ ID NO: 496 - DNA, 450 bp, Oryza sativa
  CDS (1)..(450)
atggcggaccagctcaccgacgagcagatcgccgagttcaaggaggcgttcagcctcttcgacaaggacggcgacggttgcatcactactaaggagcttggaaccgtgatgcggtcccttggtcagaacccaactgaggcggagctgcaggacatgatcaacgaggttgatgctgatggcaatgggaccattgacttcccagagttcctgaacctgatggcgaagaagatgaaggataccgactctgaggaggagctcaaggaggccttccgtgtgtttgacaaggaccagaacggtttcatctcggctgctgagctccgccacgtcatgaccaaccttggtgagaagctgaccgacgaggaagtcgacgagatgatccgtgaggctgacgtcgatggcgatggccagatcaactacgaggagttcgttaaggtcatgatggccaagtga

SEQ ID NO: 497 - protein, 149 aa, Oryza sativa
MADQLTDEQIAEFKEAFSLFDKDGDGCITTKELGTVMRSLGQNPTEAELQDMINEVDADGNGTIDFPEFLNLMAKKMKDTDSEEELKEAFRVFDKDQNGFISAAELRHVMTNLGEKLTDEEVDEMIREADVDGDGQINYEEFVKVMMAK

SEQ ID NO: 498 - DNA, 342 bp, Oryza sativa; identical to SEQ ID NO: 448
  CDS (1)..(342)

SEQ ID NO: 499 - protein, 113 aa, Oryza sativa; identical to SEQ ID NO: 449

SEQ ID NO: 500 - DNA, 1074 bp, Oryza sativa
  CDS (1)..(1074)
atgagtgacatggctgctgaatgtgggagtggcaactgtgatgcttgggcagcgagagatccttccggaatcctctccccgtacaaattcaaccgcagggaagtacagagtgaagatgtttctttgaggatcacacactgtggagtatgttatgctgatgtcatttggacacggaatatgttcaacgattcgatataccctttggttcctgggcacgagatagctggagttgtaactgaggttggtgcagacgtcaaggggttcaaagtgggcgaccatgtaggtgttggcgtatatgtgaattcatgtcaggactgcgagaactgcaatagctctctggagaaccactgctcgaaatgtgtcgtcacttacaacagtgttgattcagacgggaccgtaacaaagggtggatattccagtcatatactagtgcatcaaaggtactgctttaaaatacctgctgactaccctttgtcaaaggcagcaccactgctttgtgcgggaattaccgtatatactccaatgatacgacataacatgaaccaaccagggaagtcacttggcgtcattggactaggtgggttgggtcccatggcagtaaaatttgggaaagcctttggactcaaagtgacagtttttagtacaagtgaatcaaagagagaagaagctatcaaccttcttggtgcagataattttgtgatatcatcagatgaaaatcagatggagtcactgaaaagttcccttcacttcattattgatactgcatctggtgatcaccagttcgatccttatctctcgcttctgaaagttggtggtgtaatggtgctacttagcttcccaagtgaaatcaaagttcatcctgaaaaccttaatctcgctgcgcggagcttagctggtagtgtaacagggggtacaaaggatatccaggagatgataaacttctgtgctgcaaacaatgtttacccagatatagagatgatcaagatagactacgtcaacgaggctcttcagaggctcatcaaccgggatgtgagattccgctttgtaatcgacatcgagaactctttcaagtag

SEQ ID NO: 501 - protein, 357 aa, Oryza sativa
MSDMAAECGSGNCDAWAARDPSGILSPYKFNRREVQSEDVSLRITHCGVCYADVIWTRNMFNDSIYPLVPGHEIAGVVTEVGADVKGFKVGDHVGVGVYVNSCQDCENCNSSLENHCSKCVVTYNSVDSDGTVTKGGYSSHILVHQRYCFKIPADYPLSKAAPLLCAGITVYTPMIRHNMNQPGKSLGVIGLGGLGPMAVKFGKAFGLKVTVFSTSESKREEAINLLGADNFVISSDENQMESLKSSLHFIIDTASGDHQFDPYLSLLKVGGVMVLLSFPSEIKVHPENLNLAARSLAGSVTGGTKDIQEMINFCAANNVYPDIEMIKIDYVNEALQRLINRDVRFRFVIDIENSFK

SEQ ID NO: 502 - DNA, 450 bp, Oryza sativa
  CDS (1)..(450)
atggccgatcagctcaccgacgaacagatctccgagttcaaggaagccttcagcctcttcgacaaggacggggatggttgtattaccaccaaggaacttgggaccgtgatgcggtcacttggccagaacccaactgaggcagagctgcaggacatgataaatgaggttgatgctgatgggaatggtaccattgatttcccagaattcctgaatctcatggctcgcaagatgaaagacactgattcagaggaggagctgaaggaggctttccgcgtgtttgacaaggatcagaatggcttcatctctgcagcggagctccgccatgtgatgaccaatctcggtgagaagctgaccgacgaggaagtcgatgagatgattcgcgaggctgacgttgatggtgatggtcagatcaactatgaggagtttgtcaaagtcatgatggccaagtga

SEQ ID NO: 503 - protein, 149 aa, Oryza sativa; identical to SEQ ID NO: 401

SEQ ID NO: 504 - DNA, 786 bp, Oryza sativa
  CDS (1)..(786)
atggccgtcggaaagaacaagcgcatctccaaggggaagaagggtggcaagaagaaggcagctgatccctttgccaagaaggattggtatgacattaaggctccttctgtttttcaagtgaaaaatgttggcaaaaccctcgtctctcgtactcagggtaccaagattgcttctgaaggactcaagcatagagtgtttgaggtctccttggctgatcttcaaggggatgaggatcatgcattcaagaagattaggttgagagctgaagatgtgcaagggaagaatgttctgacaaatttctggggaatggatttcacaacagacaagctgaggtcattggtacgaaaatggcaaactcttattgaagcccatgtggatgtgaagacaactgataattacacattgaggatgttttgcattggatttaccaagagaagagctaaccaggtgaagagaacctgttatgcacaatcaagccagattagacagattcgtaggaagatgagggagatcatgaccaaccaggcaacagcatgtgatttgaaggagttggtccggaagtttattcctgagattattggaaaagagatcgagaaggcaacatctagtatttaccctctgcagaatgtgtttgttcgtaaagtcaagatcctgaaagctcctaagtttgatcttgggaaactgatggaggttcatggagattactccgaggatgttggtgcaaaggtagacagacctgctgatgaaatagtggcagaggaacccactgaaattgttggagcttga

SEQ ID NO: 505 - protein, 261 aa, Oryza sativa
MAVGKNKRISKGKKGGKKKAADPFAKKDWYDIKAPSVFQVKNVGKTLVSRTQGTKIASEGLKHRVFEVSLADLQGDEDHAFKKIRLRAEDVQGKNVLTNFWGMDFTTDKLRSLVRKWQTLIEAHVDVKTTDNYTLRMFCIGFTKRRANQVKRTCYAQSSQIRQIRRKMREIMTNQATACDLKELVRKFIPEIIGKEIEKATSSIYPLQNVFVRKVKILKAPKFDLGKLMEVHGDYSEDVGAKVDRPADEIVAEEPTEIVGA

SEQ ID NO: 506 - DNA, 702 bp, Oryza sativa
  CDS (1)..(702)
atggatcagaaagtcgatttcagtgctccgcattccatgggaaccactatcatcggcgttacttacaacggcggtgtcgttctcggagccgactctcgaaccagcactggagtgtatgttgccaaccgagcatcggacaaaatcacacagctcactgataatgtttacgtgtgtcgctctggatcggctgctgattctcagattgtctctgactatgtgcgctacttccttcaccaacacacgatacaacttggacaacctgcgacagttaaagttgctgcaaaccttgtccggcttctcgcatataacaataagaatttcttacagaccgggttaattgttggtggttgggataaatatgaaggtggacaaatttatggagttcctctgggtggaacaatagtacagcaaccttttgctatcggaggatctgggtccagttacttgtatggtttctttgaccaagcctggaaagagggaatgaccaaggatgaagccgaggatttagtaaaaaaggcagtttcactggctattgctcgtgatggtgcaagtggtggggtggtgcgaacagtcataataaactcagagggagtgaccaggaatttctaccctggcgaccaacttccattatggcatgaggaaatggaggcccacaactctctgctagacattcttggtgtcccagagccgatgagcatgtga

SEQ ID NO: 507 - protein, 233 aa, Oryza sativa
MDQKVDFSAPHSMGTTIIGVTYNGGVVLGADSRTSTGVYVANRASDKITQLTDNVYVCRSGSAADSQIVSDYVRYFLHQHTIQLGQPATVKVAANLVRLLAYNNKNFLQTGLIVGGWDKYEGGQIYGVPLGGTIVQQPFAIGGSGSSYLYGFFDQAWKEGMTKDEAEDLVKKAVSLAIARDGASGGVVRTVIINSEGVTRNFYPGDQLPLWHEEMEAHNSLLDILGVPEPMSM

SEQ ID NO: 508 - DNA, 348 bp, Oryza sativa
  CDS (1)..(348)
atgtctgatctcgacgttcagcttccatctgccttcgatccgtttgctgaggcaaatgctgaggactccggcgctggccctggagcaaaggattatgtgcatgtgcgcatccagcagcgcaacggcagaaagagtctaactactgttcagggcttaaagaaggagtacagttacaacaagatcctcaaggatctgaaaaaggagttctgctgcaatggtactgtagtccaagatccagagcttggccaggtcattcagcttcaaggtgatcagcgtaagaatgttgccacgttcctagttcaggctgggattgctaagaaggacaacatcaagattcacggtttctaa

SEQ ID NO: 509 - protein, 115 aa, Oryza sativa
MSDLDVQLPSAFDPFAEANAEDSGAGPGAKDYVHVRIQQRNGRKSLTTVQGLKKEYSYNKILKDLKKEFCCNGTVVQDPELGQVIQLQGDQRKNVATFLVQAGIAKKDNIKIHGF

SEQ ID NO: 510 - DNA, 411 bp, Oryza sativa
  CDS (1)..(411)
atggctcgtaccaagcaaaccgctcgcaaatccaccggtggaaaggctcctaggaagcaactcgccaccaaggctgcaaggaaatctgcaccgacaaccggtggagtcaagaagcctcatcgctatcgccctggaactgttgctcttcgtgagatccgaaaataccaaaagagcacagagcttctgatccgcaagctccccttccagcgtcttgttcgtgaaattgcgcaagacttcaagaccgatttgaggttccagagtcacgctgttcttgcgcttcaggaagctgcggaggcttacttggtgggtttgtttgaggacaccaacttgtgtgcgattcacgccaagagggtgaccatcatgccaaaggacattcaactcgcacgccgcatccgtggagaacgtgcttag

SEQ ID NO: 511 - protein, 136 aa, Oryza sativa; identical to SEQ ID NO: 298

SEQ ID NO: 512 - DNA, 816 bp, Oryza sativa
  CDS (1)..(816)
atgtctccttcgttggatcttcctcccaagggtggcttcagttttgatctatgccgaagaaacgcaatgcttcaaaacaagggcctcaaagccccaacctttctcaaaactggcaccactattgtcggtttagttttccaggatggtgtcattcttggtgctgatactagggcaactgaaggacctatagtggctgataaaaactgtgagaaaattcattatatggcacccaacatatattgctgtggagcaggcacagctgctgatacagaggctgtaacagacatggttagctcacagctgcaattacatcgctaccatactggtcgagaatcaagagttgttacagcgctgacccttcttaagaaacaccttttcaattatcaagggcatgtctcagctgctttggtgcttggtggggttgatatcactggacctcatttgcatactatttatcctcatgggtcaactgacaccctcccatttgctacaatgggatcaggttcacttgctgcaatgtctgtatttgagtccaagtacaaggaaagtttgagtagggatgaaggcattaagctagttgttgaggcgatatgcgctggaatatttaatgacctaggaagtggaagtaatgttgacgtttgtgtgataaccaagggacacaaggaatatctcaggaaccaccttctaccaaatcctcgtacctatgtcaatccaaaaggctttgatttccccaaaaagacagaggtcctcttaacaaagattaccccgttgaaggagaaggtggaagtgattgaaggagatgctatggaagagtaa

SEQ ID NO: 513 - protein, 271 aa, Oryza sativa
MSPSLDLPPKGGFSFDLCRRNAMLQNKGLKAPTFLKTGTTIVGLVFQDGVILGADTRATEGPIVADKNCEKIHYMAPNIYCCGAGTAADTEAVTDMVSSQLQLHRYHTGRESRVVTALTLLKKHLFNYQGHVSAALVLGGVDITGPHLHTIYPHGSTDTLPFATMGSGSLAAMSVFESKYKESLSRDEGIKLVVEAICAGIFNDLGSGSNVDVCVITKGHKEYLRNHLLPNPRTYVNPKGFDFPKKTEVLLTKITPLKEKVEVIEGDAMEE

SEQ ID NO: 514 - DNA, 450 bp, Oryza sativa
  CDS (1)..(450)
atggccgatcaacttaccgatgaacagatctccgagttcaaggaagccttcagcttgttcgacaaggacggcgatggttgcatcacaaccaaggagcttggaactgttatgcgttcattggggcaaaacccaactgaggcagagctccaggacatgatcaatgaagtggatgctgatgggaatggtaccattgacttccctgagttcctaaatctcatggccaggaagatgaaggacactgattctgaggaggagctgaaagaggcattccgggttttcgacaaggaccagaatgggttcatctctgctgctgagctccgccatgtgatgaccaacctcggggagaagctcaccgatgaagaggttgatgagatgattcgcgaggccgatgttgatggcgatggccaaataaactacgaggagttcgttaaggtgatgatggccaagtga

SEQ ID NO: 515 - protein, 149 aa, Oryza sativa; identical to SEQ ID NO: 401

SEQ ID NO: 516 - DNA, 501 bp, Oryza sativa; identical to SEQ ID NO: 450
  CDS (1)..(501)

SEQ ID NO: 517 - protein, 166 aa, Oryza sativa; identical to SEQ ID NO: 451

SEQ ID NO: 518 - DNA, 1038 bp, Oryza sativa
  CDS (1)..(1038)
atgccggcggcggcggcggcgaagacgctggtgccagcccgcggcggcggcgacatggaggagccgctgctggcggagtcgtcggatcgcttctcgatgttcccgatcaggtacccgcagatctgggagttctacaagaaggcggtggcgtcgttctggacggcggaggaggtggacctctccgccgacgcgcgccactgggacgccgcgctgtcgcccgacgagcgccacttcgtctcccacgtgctcgccttcttcgcggcctccgatggcatcgtgctcgagaacctcgcctccaggttcatgtccgacgtgcaggtcgccgaggctcgcgccttctacggcttccagatcgccatcgagaacatccactcggagatgtactcgcttctgctcgagacgtacatccgcgacgacgtcgagaaggaccgcctcttccgcgccatcgacaccgtccccgccgtgcgccgcaaggccgactgggccatgcgatggatcgacggcggcgagcgcttcgccgagcggctcgtcgccttcgcctgcgtcgaggggatcttcttctcgggttcattctgcgccatcttctggctcaagaagcgcggactcatgccgggcctcaccttctccaacgagctcatctcccgcgacgagggtctccactgcgacttcgcctgcctcctctacgacctcctccgcggcaagctcgacgagtcacgcgtccaggagatcgtcgccgacgccgtggacatcgagagggagttcgtctgcgacgcgctccccgtcgcgctcgtcgggatgaacggcgagctcatgagccagtacatcgagttcgtcgccgaccggctgctcatggcgctcgggtgcaagaagatgtacaacgtcgccaacccgttcgactggatggagctcatctccctgcagggcaagaccaacttcttcgagaagcgcgtcggcgactaccagaaggcgtccgtaatgtccagcctcaacggcggcgcttcttgcaaccatgtcttcagcatcgacgaggacttctga

SEQ ID NO: 519 - protein, 345 aa, Oryza sativa
MPAAAAAKTLVPARGGGDMEEPLLAESSDRFSMFPIRYPQIWEFYKKAVASFWTAEEVDLSADARHWDAALSPDERHFVSHVLAFFAASDGIVLENLASRFMSDVQVAEARAFYGFQIAIENIHSEMYSLLLETYIRDDVEKDRLFRAIDTVPAVRRKADWAMRWIDGGERFAERLVAFACVEGIFFSGSFCAIFWLKKRGLMPGLTFSNELISRDEGLHCDFACLLYDLLRGKLDESRVQEIVADAVDIEREFVCDALPVALVGMNGELMSQYIEFVADRLLMALGCKKMYNVANPFDWMELISLQGKTNFFEKRVGDYQKASVMSSLNGGASCNHVFSIDEDF

SEQ ID NO: 520 - DNA, 486 bp, Oryza sativa
  CDS (1)..(486)
atgatcaactttgtgcttctcattagtcgccaagggaaggtgagattgacaaaatggtactcaccttattctcagaaagaaaggagtaaggtaatccgtgagctcagtggaatgattctttcccgtgcgcccaagcaatgtaattttgtggaatggcgaggacataaagttgtttataaaaggtatgctagtctctatttctgcatgtgcattgatcaagatgacaatgaattagaagtccttgaaatgattcatcattttgtggagattcttgaccggtattttggcagtgtctgtgaactggacttaatattcaactttcacaaggcctactatatactagatgaaattctaattgccggtgagcttcaagagtccagcaagaaaacagttgcccgattgatagcagcacaggattcgttggtggagaatgcaaaggaagaagccagttcgtttagtaatataattgcacaagccactaagtga

SEQ ID NO: 521 - protein, 161 aa, Oryza sativa
MINFVLLISRQGKVRLTKWYSPYSQKERSKVIRELSGMILSRAPKQCNFVEWRGHKVVYKRYASLYFCMCIDQDDNELEVLEMIHHFVEILDRYFGSVCELDLIFNFHKAYYILDEILIAGELQESSKKTVARLIAAQDSLVENAKEEASSFSNIIAQATK

SEQ ID NO: 522 - DNA, 615 bp, Oryza sativa
  CDS (1)..(615)
atgggagcgtaccgttatatgcaagaattgtatcgcaagaagcagagcgatgtactgagatatttgcttcgtatccgagtatggcaataccgtcaactcacaaagatggttcgttcaccgcgaccatcgcgtccggacaaggcccgtcgcttgggattccgtgccaagcaaggctacgtcatctacagaattcgcgtacgccgtggaggtcgcaagcgtccagtgccaaagggttgcacctacggcaaaccaaaaagccacggtgtcaacgaattgaaaccaacacgccgattgcaatcggttgccgaggaacgcgttggtcgtcgtctcggaggacttcgcgtactcaactcctactgggtggcccaagattcctcatacaaatatttcgaagtgattttggttgatccatcacacaatgctatccgtcgcgatccaaagattaactggatctgcaaggctgtcatgaaacatcgtgaaatgcgtggccttacatcagccggcaagagttcgcgtggcgtcggaaagggatacagatattcacaaacaatcggtggatctcgacgtgctgcctggaagcgcaagaaccgtttgcatttacgcagaaagcgatag

SEQ ID NO: 523 - protein, 204 aa, Oryza sativa
MGAYRYMQELYRKKQSDVLRYLLRIRVWQYRQLTKMVRSPRPSRPDKARRLGFRAKQGYVIYRIRVRRGGRKRPVPKGCTYGKPKSHGVNELKPTRRLQSVAEERVGRRLGGLRVLNSYWVAQDSSYKYFEVILVDPSHNAIRRDPKINWICKAVMKHREMRGLTSAGKSSRGVGKGYRYSQTIGGSRRAAWKRKNRLHLRRKR

SEQ ID NO: 524 - DNA, 498 bp, Oryza sativa
atggctcgcacgaagcacccggcggtgaggaagtcgaaggcggagcccaagaagaagctccagttcgaacgctcccctcggccgtcgaaggcgcagcgcgctggtggcggcacgggtacctcggcgaccacgaggagcgcggctggaacatcggcttcagcagggacgcctaggcagcaaacgaagcagaggaagccacaccgcttccgtccaggcacagtggcactgcgggagatcaggaaatttcagaaaaccaccgaactgctgatcccgtttgcaccattttctcggctggtcagggagatcactgatttctattcaaaggatgtgtcacggtggacccttgaagctctccttgcattgcaagaggcagcagaataccacttagtggacatatttgaagtgtcaaatctctgcgccatccatgctaagcgtgttaccatcatgcaaaaggacatgcaacttgccaggcgtatcggtgggcggaggccatggtga

SEQ ID NO: 525 - DNA, 543 bp, Oryza sativa
  CDS (1)..(543)
atgggttggatcggtgagactgttgattccatcaaatctcttcagatccgccaggtcctcacccaggctgtgagcctaggcatgattgttacgtctgcactgataatatggaaggcattgatgtgcgttactggcagtgaatctcccgttgttgttgttctttctggaagcatggaacccggattcaagcggggagacatcttgttcttgcacatgagtaaagatcctattcgggcaggggagattgttgtgtttaatgttgatggacgtgagattccaattgttcatcgtgtaattaaggtacatgaaagggaagatactggggaggttgatgttctcacaaaaggagacaacaattatggggatgacaggctactgtatgctcatggtcaactttggctgcaaaggcaccacattatgggtagagccgtcgggttcttaccatacgtaggctgggtgaccatcattatgactgaaaagcctattatcaagtatattctcattggtgctttggggttgctcgtgataacttcgaaagattaa

SEQ ID NO: 526 - protein, 180 aa, Oryza sativa
MGWIGETVDSIKSLQIRQVLTQAVSLGMIVTSALIIWKALMCVTGSESPVVVVLSGSMEPGFKRGDILFLHMSKDPIRAGEIVVFNVDGREIPIVHRVIKVHEREDTGEVDVLTKGDNNYGDDRLLYAHGQLWLQRHHIMGRAVGFLPYVGWVTIIMTEKPIIKYILIGALGLLVITSKD

SEQ ID NO: 527 - DNA, 543 bp, Oryza sativa; identical to SEQ ID NO: 525
  CDS (1)..(543)

SEQ ID NO: 528 - protein, 180 aa, Oryza sativa; identical to SEQ ID NO: 526

SEQ ID NO: 529 - DNA, 486 bp, Oryza sativa
  CDS (1)..(486)
atgatacattttgtgctcctcatcagcagacaagggaaggtgaggctgaccaaatggtacaatccatatcctcagaaggaaagatccaaggttatcaaagaagtaagtacgctcgtcctgacaagaggtccaaagatgtgcaattttgtcgattggcacggatacagagttgtatacaaaaggtatgcaagcctttacttctgcatgtgcattgatgctgctgataatgaactggagactcttcaaatcatccatcattttgttgagatattggaccgatattttggcaatgtctgcgagcttgacctgatattcaacttccacaaggcatactttatattggatgaggttctgattgccggtgagcttcaagaatcgaacaagaaagcagtactacgcctgatcactacacaggacaacttggtggaagcagcaaaggaagaggcaagctcattgaggaacataattgcacaggccaccaagtag

SEQ ID NO: 530 - protein, 161 aa, Oryza sativa
MIHFVLLISRQGKVRLTKWYNPYPQKERSKVIKEVSTLVLTRGPKMCNFVDWHGYRVVYKRYASLYFCMCIDAADNELETLQIIHHFVEILDRYFGNVCELDLIFNFHKAYFILDEVLIAGELQESNKKAVLRLITTQDNLVEAAKEEASSLRNIIAQATK

SEQ ID NO: 531 - DNA, 1083 bp, Oryza sativa
  CDS (1)..(1083)
atggaggtcacccccaaccacacgcagaccgtctccggctgggccgccatggacgagtccggcaagatcgtgcccttcgtcttcaagagaagggagaacggggtggacgacgtgacgatcaaggtgaagtactgcgggatgtgccacacggacctgcacttcatccacaacgactgggggatcaccatgtacccggtggtgccggggcacgagatcaccggcgtggtgaccaaggtgggcaccaacgtggccgggttcaaggtgggcgaccgcgtgggcgtggggtgcatcgcggcgtcgtgcctcgactgcgagcactgccggcggtcggaggagaactactgcgacaaggtggcgctcacctacaacggcatcttctgggacggcagcatcacctacggcggctactccggcatgctggtggcgcacaagcggttcgtcgtgcggatcccggacaccctcccgctggacgccgcggcgccgctgctgtgcgcgggcatcacggtgtacagccccatgaagcagcacggcatgctgcaggccgacgcggccggccggcggctcggcgtggtcggcctcggcggcctcggccacgtcgccgtcaagttcggcaaggcgttcggcctccacgtcaccgtcatcagcacgtctccggccaaggagcgcgaggccagggagaacctcaaggccgacaacttcgtcgtcagcaccgaccagaagcagatgcaggctatgacgaggagccttgactacatcattgacacggtcgcggcgacgcactctctgggtccgatcctggagctgctcaaggtcaacggcaagctggtgctcgtgggcgcgccggagaagcccgtcgagctcccttccttccctctcatcttcggtaagaggacggtgagtgggagcatgacgggtgggatgaaggagacgcaggagatgatggacatttgcggggagcacaacatcacctgcgacatcgagatcgtgtccacggacaggatcaacgatgcgctcgccaggttggcgcgcaacgacgtccgctaccgcttcgtcatcaacgttgggggcgactccaagctctag

SEQ ID NO: 532 - protein, 360 aa, Oryza sativa
MEVTPNHTQTVSGWAAMDESGKIVPFVFKRRENGVDDVTIKVKYCGMCHTDLHFIHNDWGITMYPVVPGHEITGVVTKVGTNVAGFKVGDRVGVGCIAASCLDCEHCRRSEENYCDKVALTYNGIFWDGSITYGGYSGMLVAHKRFVVRIPDTLPLDAAAPLLCAGITVYSPMKQHGMLQADAAGRRLGVVGLGGLGHVAVKFGKAFGLHVTVISTSPAKEREARENLKADNFVVSTDQKQMQAMTRSLDYIIDTVAATHSLGPILELLKVNGKLVLVGAPEKPVELPSFPLIFGKRTVSGSMTGGMKETQEMMDICGEHNITCDIEIVSTDRINDALARLARNDVRYRFVINVGGDSKL

SEQ ID NO: 533 - DNA, 639 bp, Oryza sativa
  CDS (1)..(639)
atgggctcgaagccgccgccgccgccgcagcccagcgtctccttcaagctcgtcctcctcggcgacgggagagtaggcaaaacatctcttgtgctgcggtatgtgaatgatgtcttctcagacaaacaggaagcaactgttcaagcttcatatttgacaaagcgccttgttgttgaaggtgtgcctattacgctctctatctgggatacagctggacaagagaagttccatgcactaggccctatatactatcgtgatgcagacgctgctcttttagtatatgacatcacagacaatgatacttttcttcgtgtcacaaagtgggtgaaagagcttaagcaaatggcaaataaagatattgttatggccattgcagcaaataaaagtgacctggttagatcaaaacacatagacactaatgaagcagcaagctatgcagaaagtattggggcaactctctttgttacttctgccaaagctggtactgggattgatgatatcttcagtgacatagccaagagattattagagagaagaaaaaacagctccgatggcttgtcactggctcatccaaagaaaggcattttaatcgtcgacgatgaacctgagaaagaacctccaccaaagtgctgctcatag

SEQ ID NO: 534 - protein, 212 aa, Oryza sativa
MGSKPPPPPQPSVSFKLVLLGDGRVGKTSLVLRYVNDVFSDKQEATVQASYLTKRLVVEGVPITLSIWDTAGQEKFHALGPIYYRDADAALLVYDITDNDTFLRVTKWVKELKQMANKDIVMAIAANKSDLVRSKHIDTNEAASYAESIGATLFVTSAKAGTGIDDIFSDIAKRLLERRKNSSDGLSLAHPKKGILIVDDEPEKEPPPKCCS

SEQ ID NO: 535 - DNA, 411 bp, Oryza sativa
  CDS (1)..(411)
atggcccgcacgaagcagacggcgaggaagtccaccggcggcaaggcgccgaggaagcagctggcgacgaaggcggcgcgcaagtcggccccggcgaccggcggcgtgaagaagccccaccgcttcaggccgggaaccgtcgcgctccgggagatccgcaagtaccagaagagcacggagctgctcatccgcaagctgccgttccagcggctggtgcgggagatcgcgcaggacttcaagaccgacctccgcttccagagctccgccgtcgccgcgctgcaggaggccgccgaggcctacctcgtcgggctcttcgaggacaccaacctctgcgccatccacgccaagcgcgtcaccatcatgcccaaggacatccagctcgcccgccgcatccgtggcgagagggcgtag

SEQ ID NO: 536 - protein, 136 aa, Oryza sativa; identical to SEQ ID NO: 306

SEQ ID NO: 537 - DNA, 291 bp, Oryza sativa
atgcctaaggccgcaactggaaagcgtggtgtcggcaagatcgagaaggtcaagcgcggtaagaaggaccccaacgctcctaagcgcggtctctctgcctacatgttcttcgccaatgagcagcgtgagaacgtccgtgatgagaaccccggcatcagcttcggccaggtcggcaagctccttggccagcgctggaaggcactcgacgacaagcagcgtgccccctacgaggccaaggctgccgctgacaagaagcgctacgaggacgagaaggccgcctacaactcttaa

SEQ ID NO: 538 - protein, 75 aa, Oryza sativa
MSSVRTSVMRTPASASARSASSLASAGRHSTTSSVPPTRPRLPLTRSATRTRRPPTTLKWFPTTVMSQFYDDLPI

SEQ ID NO: 539 - DNA, 318 bp, Oryza sativa
  CDS (1)..(318)
atggcggaggaagccactcaggggaagaaggaggaggaggaattcagtacggggccgctgtccgtgctgatgatgagcgtgaagaacaacacccaggtgcttatcaattgccggaacaacaagaagttgcttggtcgtgtgagggcatttgatcgccattgcaacatggttcttgagaatgttagggagatgtggactgaggtaccaaagactggtaaaggcaagaagaaggctcttccagtgaacaaggacaggttcattagcaagatgttcctacgtggggattcggtcatcattgtgctcaggaacccgaaatga

SEQ ID NO: 540 - protein, 105 aa, Oryza sativa
MAEEATQGKKEEEEFSTGPLSVLMMSVKNNTQVLINCRNNKKLLGRVRAFDRHCNMVLENVREMWTEVPKTGKGKKKALPVNKDRFISKMFLRGDSVIIVLRNPK

SEQ ID NO: 541 - DNA, 330 bp, Oryza sativa
  CDS (1)..(330)
atggccaccttcgagctgtaccggaggtccaccatcggtatgtgcctcaccgacacgctggacgacatggtctccagtggggcgctcagccccgagctcgccatccaagtcctcgtgcagtttgacaagtccatgactagcgctttggagcatcaggtgaagagcaaggttactgtcaagggccatctgcacacctacaggttctgcgacaatgtgtggactttcatcctaacagatgcaattttcaagaacgaagagattacagagacaataaacaaggtgaagatcgtggcctgcgattccaaattgctggagactaaagaagagtaa

SEQ ID NO: 542 - protein, 109 aa, Oryza sativa
MATFELYRRSTIGMCLTDTLDDMVSSGALSPELAIQVLVQFDKSMTSALEHQVKSKVTVKGHLHTYRFCDNVWTFILTDAIFKNEEITETINKVKIVACDSKLLETKEE

SEQ ID NO: 543 - DNA, 645 bp, Oryza sativa
  CDS (1)..(645)
atgagctcggcggcggcggcgacgaggttcatcaagtgcgtcaccgtgggggacggcgcggtggggaagacgtgcatgctcatctgctacacctgcaacaagttccccaccgattacatccccaccgtgttcgacaacttcagcgccaatgtctccgtggacgggagcgtcgtcaacctcggcctctgggacactgcaggtcaggaggattacagcaggttgaggcctctgagctacaggggagccgatgtgttcatcctgtccttctccctgataagcagggcgagctatgagaatgttcagaagaagtggatgccagagcttcgccggtttgcgcctggtgttcctgtagttcttgttggaaccaagttggatctccgtgaagatagggcctatcttgctgatcatccagcttcttccataataacaacggagcagggagaagaactgaggaagctaataggagcggtcgcctacatcgaatgcagctccaagacacagagaaacattaaagctgttttcgacactgccatcaaagtggtgcttcaacctccaagacataaggatgtaaccagaaagaaactccaatcaagctccaatcggccagtaaggcggtacttttgcggaagcgcttgtttcgcgtag

SEQ ID NO: 544 - protein, 214 aa, Oryza sativa
MSSAAAATRFIKCVTVGDGAVGKTCMLICYTCNKFPTDYIPTVFDNFSANVSVDGSVVNLGLWDTAGQEDYSRLRPLSYRGADVFILSFSLISRASYENVQKKWMPELRRFAPGVPVVLVGTKLDLREDRAYLADHPASSIITTEQGEELRKLIGAVAYIECSSKTQRNIKAVFDTAIKVVLQPPRHKDVTRKKLQSSSNRPVRRYFCGSACFA

SEQ ID NO: 545 - DNA, 321 bp, Oryza sativa
  CDS (1)..(321)
atggccaccttcgagctctaccggaggtccaccattggcatgtgcctcactgagacgctcgacgagatggtctccagcggcaccctcagcccggagctcgccattcaagttcttgtccagtttgataagtctatgacggaagccttggagaaccaagtcaagagcaaggtttctatcaagggccacctgcacacttacaggttctgtgacaatgtatggacattcatcttgactgaagcatcattcaagaacgaggagactacagaacaagttggcaaggtgaagattgtggcctgtgattccaaactactcagccaataa

SEQ ID NO: 546 - protein, 106 aa, Oryza sativa
MATFELYRRSTIGMCLTETLDEMVSSGTLSPELAIQVLVQFDKSMTEALENQVKSKVSIKGHLHTYRFCDNVWTFILTEASFKNEETTEQVGKVKIVACDSKLLSQ

SEQ ID NO: 547 - DNA, 411 bp, Oryza sativa
  CDS (1)..(411)
atggcccgcacaaagcagacggcgaagaagtccaccgccagcaatgtgccgaggaagctgctggtgatgaaggtggcacgcaagtcagcaccgacgatggcagggctgaagaagccacaccgcttcaagccagggaccgtcgcactccgagagatccgcacataccagaagagcacagagctgctaatccgcaagctccccttccagcggctggtgcaggagatcgcgcaggacgttaggtcctatgttcgcttccagagctctgccgtggttgcgctgcaggaggctgccgagacctaccttgtggggctcttcaaggacaccaacctctgtgttatccatgccaaacgcgtcaccatcatgcccaaggacatccagctcgcgcgccgcatcaggggcgagaaggcctag

SEQ ID NO: 548 - protein, 136 aa, Oryza sativa
MARTKQTAKKSTASNVPRKLLVMKVARKSAPTMAGLKKPHRFKPGTVALREIRTYQKSTELLIRKLPFQRLVQEIAQDVRSYVRFQSSAVVALQEAAETYLVGLFKDTNLCVIHAKRVTIMPKDIQLARRIRGEKA

SEQ ID NO: 549 - DNA, 348 bp, Oryza sativa
  CDS (1)..(348)
atgtctgatctcgacattcagatcccaactgccttcgatccctttgctgaggccaatgctggagactctggtgcggctgcaggatcaaaggactacgttcatgtacgcatccagcagcgtaatggccgtaagagcctgaccactgtccagggattgaagaaggaattcagctacaacaagatcctcaaagatctcaagaaagagttttgctgcaatggtactgttgtccaggacccagagcttggccaggtcattcaacttcagggtgatcagaggaaaaacgtatcaaattttcttgttcaggccggcattgtgaagaaggaacacatcaagattcatggtttctga

SEQ ID NO: 550 - protein, 115 aa, Oryza sativa
MSDLDIQIPTAFDPFAEANAGDSGAAAGSKDYVHVRIQQRNGRKSLTTVQGLKKEFSYNKILKDLKKEFCCNGTVVQDPELGQVIQLQGDQRKNVSNFLVQAGIVKKEHIKIHGF

SEQ ID NO: 551 - DNA, 834 bp, Oryza sativa
  CDS (1)..(834)
atgaagctggacgtctccgccatggagaacaacttcgccgcccacgccgccggcggcgaggacgacggcggcctcttcggcgccggcgccgacctgcccgccatggagctccccacctgccccgccgacttcgacgggttccagaaggagaccaaggagatgctgaagcacaagaagggaacgaccacgctcgcgttcatcttcgacaagggcgtcatcgtcgccgccgactcccgcgccagcatgggcggatacatatcttcgcaaactgtgaggaaaattattgaaataaatccgtacatgcttggaacaatggcaggaggtgctgctgattgtcaattttggcataggaacttgggcatcaagtgccgactccatgagctcgcgaacaagcggaggatctctattgctggtgcttcaaagcttttggccaacatcctgtactcctaccgtgggatgggactgtcaattggtacaatgattgctggatgggatgagaagggtcctggcttgtactatgttgatagtgagggcgcaaggctcatgggaagccgattctctgttggatcaggttctctgtatgcctatggtatcttggacgagggttaccgctatgtgatgccagttgaggaagctgctgagttagcaaggcgggctatttaccaagctacattccgtgatggggcaagtggtggttgtgttagcgtttaccatgttggcccgaacggctggacgaagctttctggagatgatgttggggagctgcactacaagtactacccggttgaggccactcctgtcgagcaggaaatggccgatgccccagctgcttaa

SEQ ID NO: 552 - protein, 277 aa, Oryza sativa
MKLDVSAMENNFAAHAAGGEDDGGLFGAGADLPAMELPTCPADFDGFQKETKEMLKHKKGTTTLAFIFDKGVIVAADSRASMGGYISSQTVRKIIEINPYMLGTMAGGAADCQFWHRNLGIKCRLHELANKRRISIAGASKLLANILYSYRGMGLSIGTMIAGWDEKGPGLYYVDSEGARLMGSRFSVGSGSLYAYGILDEGYRYVMPVEEAAELARRAIYQATFRDGASGGCVSVYHVGPNGWTKLSGDDVGELHYKYYPVEATPVEQEMADAPAA

SEQ ID NO: 553 - DNA, 411 bp, Oryza sativa
  CDS (1)..(411)
atggcccgtaccaagcagaccgctcgtaagtccacaggaggaaaggctcccaggaagcagcttgcaaccaaggctgctcgtaagtctgctcccaccactggaggagttaagaagccccaccgttaccgccctggaactgttgccctccgtgagattcgcaagtaccagaagagtactgagcttttgatcaggaagctgcccttccagaggcttgttagggaaattgcacaggacttcaagaccgatctgcgtttccagagccatgctgtccttgccctccaggaggctgcggaggcataccttgttggtctcttcgaggacaccaacctgtgcgctattcatgccaagcgtgtgaccatcatgcctaaggacattcagctggctaggaggattcgtggtgagagggcttaa

SEQ ID NO: 554 - protein, 136 aa, Oryza sativa; identical to SEQ ID NO: 298

SEQ ID NO: 555 - DNA, 450 bp, Oryza sativa
  CDS (1)..(450)
atggcagatcagctcaccgacgaccagatcgccgagttcaaggaggccttcagcctcttcgacaaggacggcgatggttgcatcacaaccaaggagttgggaactgtcatgcgttcactagggcagaacccaacggaagctgagctccaggacatgatcaacgaggttgatgctgatggcaatggaaccattgattttcctgagtttctcaatctgatggctcgcaagatgaaggacactgattcagaggaagaactcaaggaggccttccgggtgtttgacaaggaccaaaatggcttcatctccgctgctgagctccgccatgtgatgacaaatcttggcgagaagctaactgacgaggaggtggatgagatgatccgtgaggctgatgttgatggtgatggtcagataaactatgaggagtttgtgaaggtcatgatggccaagtga

SEQ ID NO: 556 - protein, 149 aa, Oryza sativa
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 557 - protein, 13 aa, Saccharomyces cerevisiae
  misc_feature (2)..(2): Xaa can be any naturally occurring amino acid
  misc_feature (4)..(5): Xaa can be any naturally occurring amino acid
  misc_feature (8)..(10): Xaa can be any naturally occurring amino acid
KXVXXGDXXXGKT

SEQ ID NO: 558 - protein, 9 aa, Saccharomyces cerevisiae
  misc_feature (2)..(4): Xaa can be any naturally occurring amino acid
  misc_feature (6)..(7): Xaa can be any naturally occurring amino acid
FXXXYXXTV

SEQ ID NO: 559 - protein, 7 aa, Saccharomyces cerevisiae
WDTAGQE

SEQ ID NO: 560 - protein, 7 aa, Saccharomyces cerevisiae
  misc_feature (5)..(5): Xaa can be any naturally occurring amino acid
VGTKXDL

SEQ ID NO: 561 - DNA, 45 bp, Artificial Sequence
  misc_feature (1)..(45): primer forward
ggaattccagctgaccaccatggatggagccaaatttgaaaatac

SEQ ID NO: 562 - DNA, 47 bp, Artificial Sequence
  misc_feature (1)..(47): primer forward
ggaattccagctgaccaccatgagcgaaataaataatgaaaatctag

SEQ ID NO: 563 - DNA, 43 bp, Artificial Sequence
  misc_feature (1)..(43): primer forward
ggaattccagctgaccaccatgcagtttccattcgcttgtctc

SEQ ID NO: 564 - DNA, 45 bp, Artificial Sequence
  misc_feature (1)..(45): primer forward
ggaattccagctgaccaccatgaaatttttgaagaacaaagcacc

SEQ ID NO: 565 - DNA, 43 bp, Artificial Sequence
  misc_feature (1)..(43): primer forward
ggaattccagctgaccaccatgtgcgccagtttaaacgaggta

SEQ ID NO: 566 - DNA, 44 bp, Artificial Sequence
  misc_feature (1)..(44): primer forward
ggaattccagctgaccaccatggtcgtaattaacggggtcaaat

SEQ ID NO: 567 - DNA, 43 bp, Artificial Sequence
  misc_feature (1)..(43): primer forward
ggaattccagctgaccaccatgttgcagctaaggtttatgcct

SEQ ID NO: 568 - DNA, 42 bp, Artificial Sequence
  misc_feature (1)..(42): primer forward
ggaattccagctgaccaccatgaagctcccacagaccatgct

SEQ ID NO: 569 - DNA, 42 bp, Artificial Sequence
  misc_feature (1)..(42): primer forward
ggaattccagctgaccaccatggctctagctatctcccacga

SEQ ID NO: 570 - DNA, 46 bp, Artificial Sequence
  misc_feature (1)..(46): primer forward
ggaattccagctgaccaccatggttttttcttatgagcactatatg

SEQ ID NO: 571 - DNA, 43 bp, Artificial Sequence
  misc_feature (1)..(43): primer forward
ggaattccagctgaccaccatgcgatatactgcaacttttcgg

SEQ ID NO: 572 - DNA, 43 bp, Artificial Sequence
  misc_feature (1)..(43): primer forward
ggaattccagctgaccaccatgcaattctctaccgtcgcttct

SEQ ID NO: 573 - DNA, 44 bp, Artificial Sequence
  misc_feature (1)..(44): primer forward
ggaattccagctgaccaccatgaatagcgagtacgattacctgt

SEQ ID NO: 574 - DNA, 41 bp, Artificial Sequence
  misc_feature (1)..(41): primer forward
ggaattccagctgaccaccatggcccgcaatagacaagcgt

SEQ ID NO: 575 - DNA, 43 bp, Artificial Sequence
  misc_feature (1)..(43): primer forward
ggaattccagctgaccaccatgtcggatgtagataactgggaa

SEQ ID NO: 576 - DNA, 43 bp, Artificial Sequence
  misc_feature (1)..(43): primer forward
ggaattccagctgaccaccatgcctccaaagaagcaagtcgaa

SEQ ID NO: 577 - DNA, 44 bp, Artificial Sequence
  misc_feature (1)..(44): primer forward
ggaattccagctgaccaccatgactgtggttgaaataaaaagcc

SEQ ID NO: 578 - DNA, 46 bp, Artificial Sequence
  misc_feature (1)..(46): primer forward
ggaattccagctgaccaccatgcacattcttttcttgtttattttc

SEQ ID NO: 579 - DNA, 44 bp, Artificial Sequence
  misc_feature (1)..(44): primer forward
ggaattccagctgaccaccatgtctaccttttctgcttctgatt

SEQ ID NO: 580 - DNA, 44 bp, Artificial Sequence
  misc_feature (1)..(44): primer forward
ggaattccagctgaccaccatgaaaggttcaaaatcgcaccttg

SEQ ID NO: 581 - DNA, 43 bp, Artificial Sequence
  misc_feature (1)..(43): primer forward
ggaattccagctgaccaccatgccgaagaatagtcaccaccat

SEQ ID NO: 582 - DNA, 43 bp, Artificial Sequence
  misc_feature (1)..(43): primer forward
ggaattccagctgaccaccatgtcccaacgatcttcacaacac

SEQ ID NO: 583 - DNA, 43 bp, Artificial Sequence
  misc_feature (1)..(43): primer forward
ggaattccagctgaccaccatggccgatgaggaacgtttaaag

SEQ ID NO: 584 - DNA, 43 bp, Artificial Sequence
  misc_feature (1)..(43): primer forward
ggaattccagctgaccaccatgatcgctttgaagcccaatgct

SEQ ID NO: 585 - DNA, 47 bp, Artificial Sequence
  misc_feature (1)..(47): primer forward
ggaattccagctgaccaccatgaaggatttaaaattatcgaatttca

SEQ ID NO: 586 - DNA, 44 bp, Artificial Sequence
  misc_feature (1)..(44): primer forward
ggaattccagctgaccaccatggagaccaatttttccttcgact

SEQ ID NO: 587 - DNA, 42 bp, Artificial Sequence
  misc_feature (1)..(42): primer forward
ggaattccagctgaccaccatgaaatgtcacgcgaaacggac

SEQ ID NO: 588 - DNA, 46 bp, Artificial Sequence
  misc_feature (1)..(46): primer forward
ggaattccagctgaccaccatgaaaactgatagattactgattaac

SEQ ID NO: 589 - DNA, 48 bp, Artificial Sequence
  misc_feature (1)..(48): primer forward
ggaattccagctgaccaccatgacaaaaagtgatttattatttgataa

SEQ ID NO: 590 - DNA, 44 bp, Artificial Sequence
  misc_feature (1)..(44): primer forward
ggaattccagctgaccaccatgaaaggctcacccatttctcaat

SEQ ID NO: 591 - DNA, 45 bp, Artificial Sequence
  misc_feature (1)..(45): primer forward
ggaattccagctgaccaccatggcgtataatcaagaagatagtaa

SEQ ID NO: 592 - DNA, 50 bp, Artificial Sequence
  misc_feature (1)..(50): primer forward
ggaattccagctgaccaccatgacctttttacaatttatcaataataata

SEQ ID NO: 593 - DNA, 41 bp, Artificial Sequence
  misc_feature (1)..(41): primer forward
ggaattccagctgaccaccatgagtctctcgcaggtgtcac

SEQ ID NO: 594 - DNA, 44 bp, Artificial Sequence
  misc_feature (1)..(44): primer forward
ggaattccagctgaccaccatggatccaagtttagttttagagc

SEQ ID NO: 595 - DNA, 41 bp, Artificial Sequence
  misc_feature (1)..(41): primer forward
ggaattccagctgaccaccatggagagtcgaactacagggc

SEQ ID NO: 596 - DNA, 43 bp, Artificial Sequence
  misc_feature (1)..(43): primer forward
ggaattccagctgaccaccatgtgcattttaatggccacaagg

SEQ ID NO: 597 - DNA, 41 bp, Artificial Sequence
  misc_feature (1)..(41): primer forward
ggaattccagctgaccaccatgtacatggccagatgtggcc

SEQ ID NO: 598 - DNA, 40 bp, Artificial Sequence
  misc_feature (1)..(40): primer forward
ggaattccagctgaccaccatgcagacaatgggcggggag

SEQ ID NO: 599 - DNA, 46 bp, Artificial Sequence
  misc_feature (1)..(46): primer forward
ggaattccagctgaccaccatgattcaatttaaaagtccaggtaac

SEQ ID NO: 600 - DNA, 44 bp, Artificial Sequence
  misc_feature (1)..(44): primer forward
ggaattccagctgaccaccatgtcatctgacaactctaaacaag

SEQ ID NO: 601 - DNA, 43 bp, Artificial Sequence
  misc_feature (1)..(43): primer forward
ggaattccagctgaccaccatgtcgacagcacagaaagctaag

SEQ ID NO: 602 - DNA, 45 bp, Artificial Sequence
  misc_feature (1)..(45): primer forward
ggaattccagctgaccaccatgaacaaagaattggcttctaagtt

SEQ ID NO: 603 - DNA, 43 bp, Artificial Sequence
  misc_feature (1)..(43): primer forward
ggaattccagctgaccaccatggaaactgaagtacctgcacca

SEQ ID NO: 604 - DNA, 44 bp, Artificial Sequence
  misc_feature (1)..(44): primer forward
ggaattccagctgaccaccatggatgatataagcggaaggcaaa

SEQ ID NO: 605 - DNA, 42 bp, Artificial Sequence
  misc_feature (1)..(42): primer forward
ggaattccagctgaccaccatgcctgtcccatctgttactgt

SEQ ID NO: 606 - DNA, 45 bp, Artificial Sequence
  misc_feature (1)..(45): primer forward
ggaattccagctgaccaccatgtacattcctaaacattttgagtc

SEQ ID NO: 607 - DNA, 42 bp, Artificial Sequence
  misc_feature (1)..(42): primer forward
ggaattccagctgaccaccatggcagtacccgggtattacga

SEQ ID NO: 608 - DNA, 47 bp, Artificial Sequence
  misc_feature (1)..(47): primer forward
ggaattccagctgaccaccatgactaaaagtatatatattatcatcg

SEQ ID NO: 609 - DNA, 44 bp, Artificial Sequence
  misc_feature (1)..(44): primer forward
ggaattccagctgaccaccatgttcttaagaagcgttaaccgtg

SEQ ID NO: 610 - DNA, 41 bp, Artificial Sequence
  misc_feature (1)..(41): primer forward
ggaattccagctgaccaccatgactcgtcccccattggttc

SEQ ID NO: 611 - DNA, 46 bp, Artificial Sequence
  misc_feature (1)..(46): primer forward
ggaattccagctgaccaccatgaatctaagatttgaattgcagaaa

SEQ ID NO: 612 - DNA, 42 bp, Artificial Sequence
  misc_feature (1)..(42): primer forward
ggaattccagctgaccaccatggccaagaggaaatatggcag

SEQ ID NO: 613 - DNA, 43 bp, Artificial Sequence
  misc_feature (1)..(43): primer forward
ggaattccagctgaccaccatgatcgccttaccagtagagaag

SEQ ID NO: 614 - DNA, 44 bp, Artificial Sequence
  misc_feature (1)..(44): primer forward
ggaattccagctgaccaccatgttcaggatacaactgagaacta

SEQ ID NO: 615 - DNA, 45 bp, Artificial Sequence
  misc_feature (1)..(45): primer forward
ggaattccagctgaccaccatggatgataagaaaacatggagtac

SEQ ID NO: 616 - DNA, 46 bp, Artificial Sequence
  misc_feature (1)..(46): primer forward
ggaattccagctgaccaccatgaatcttaaactttctgctattgaa

SEQ ID NO: 617 - DNA, 46 bp, Artificial Sequence
  misc_feature (1)..(46): primer forward
ggaattccagctgaccaccatgattcatgcagttctaatatgtatg

SEQ ID NO: 618 - DNA, 45 bp, Artificial Sequence
  misc_feature (1)..(45): primer forward
ggaattccagctgaccaccatggaagcacataaccaatttttgaa

SEQ ID NO: 619 - DNA, 44 bp, Artificial Sequence
  misc_feature (1)..(44): primer forward
ggaattccagctgaccaccatgtcacagatagcacaagaaatga

SEQ ID NO: 620 - DNA, 44 bp, Artificial Sequence
  misc_feature (1)..(44): primer forward
ggaattccagctgaccaccatgaatggaattcaagtggacatca

SEQ ID NO: 621 - DNA, 43 bp, Artificial Sequence
  misc_feature (1)..(43): primer forward
ggaattccagctgaccaccatgtgcagtaggatactcttgtcc

SEQ ID NO: 622 - DNA, 41 bp, Artificial Sequence
  misc_feature (1)..(41): primer forward
ggaattccagctgaccaccatgccgcatttagccgccgaag

SEQ ID NO: 623 - DNA, 45 bp, Artificial Sequence
  misc_feature (1)..(45): primer forward
ggaattccagctgaccaccatgttaaaagttcctttgagtgatgt

SEQ ID NO: 624 - DNA, 44 bp, Artificial Sequence
  misc_feature (1)..(44): primer forward
ggaattccagctgaccaccatggacagagaccatattaatgacc

SEQ ID NO: 625 - DNA, 43 bp, Artificial Sequence
  misc_feature (1)..(43): primer forward
ggaattccagctgaccaccatggctgtcggaaagaataagaga

SEQ ID NO: 626 - DNA, 43 bp, Artificial Sequence
  misc_feature (1)..(43): primer forward
ggaattccagctgaccaccatgtatctcagtgcccagcttatg

SEQ ID NO: 627 - DNA, 44 bp, Artificial Sequence
  misc_feature (1)..(44): primer forward
ggaattccagctgaccaccatgggtggagaaattattactttgc

SEQ ID NO: 628 - DNA, 44 bp, Artificial Sequence
  misc_feature (1)..(44): primer forward
ggaattccagctgaccaccatgggtgcctacaaatatttggaag

SEQ ID NO: 629 - DNA, 44 bp, Artificial Sequence
  misc_feature (1)..(44): primer forward
ggaattccagctgaccaccatgttgaacgtgctattgagaagga

SEQ ID NO: 630 - DNA, 43 bp, Artificial Sequence
  misc_feature (1)..(43): primer forward
ggaattccagctgaccaccatgtctaaagggagggtcaatcag

SEQ ID NO: 631 - DNA, 44 bp, Artificial Sequence
  misc_feature (1)..(44): primer forward
ggaattccagctgaccaccatgtcatcaagaataattgtcggca

SEQ ID NO: 632 - DNA, 45 bp, Artificial Sequence
  misc_feature (1)..(45): primer forward
ggaattccagctgaccaccatgtcctcacaagaatatacaacttt

SEQ ID NO: 633 - DNA, 43 bp, Artificial Sequence
  misc_feature (1)..(43): primer forward
ggaattccagctgaccaccatgtcgcaccaaaaccagcttatt

SEQ ID NO: 634 - DNA, 44 bp, Artificial Sequence
  misc_feature (1)..(44): primer forward
ggaattccagctgaccaccatgggtaagaaaaacactaaaggtg

SEQ ID NO: 635 - DNA, 44 bp, Artificial Sequence
  misc_feature (1)..(44): primer forward
ggaattccagctgaccaccatgataaaagtcgatacttccgatg

SEQ ID NO: 636 - DNA, 43 bp, Artificial Sequence
  misc_feature (1)..(43): primer forward
ggaattccagctgaccaccatgactgtttctacttccaagacc

SEQ ID NO: 637 - DNA, 45 bp, Artificial Sequence
  misc_feature (1)..(45): primer forward
ggaattccagctgaccaccatgagttccctattaatatcatacga

SEQ ID NO: 638 - DNA, 44 bp, Artificial Sequence
  misc_feature (1)..(44): primer forward
ggaattccagctgaccaccatgagagactctaatcatcgatcat

SEQ ID NO: 639 - DNA, 45 bp, Artificial Sequence
  misc_feature (1)..(45): primer forward
ggaattccagctgaccaccatgcgtctaaaagaattgttacctaa

SEQ ID NO: 640 - DNA, 45 bp, Artificial Sequence
  misc_feature (1)..(45): primer forward
ggaattccagctgaccaccatgtcttatcctgagaaatttgaagg

SEQ ID NO: 641 - DNA, 44 bp, Artificial Sequence
  misc_feature (1)..(44): primer forward
ggaattccagctgaccaccatgcgttcttcggtatatagtgaga

SEQ ID NO: 642 - DNA, 42 bp, Artificial Sequence
  misc_feature (1)..(42): primer forward
ggaattccagctgaccaccatgtcgcgggaggcatttgatgt

SEQ ID NO: 643 - DNA, 44 bp, Artificial Sequence
  misc_feature (1)..(44): primer forward
ggaattccagctgaccaccatggagagtatatttggtgggtttg

SEQ ID NO: 644 - DNA, 43 bp, Artificial Sequence
  misc_feature (1)..(43): primer forward
ggaattccagctgaccaccatgtcaacgcactcaaacgactac

SEQ ID NO: 645 - DNA, 45 bp, Artificial Sequence
  misc_feature (1)..(45): primer forward
ggaattccagctgaccaccatgttgctaataagaaggacgataaa

SEQ ID NO: 646 - DNA, 45 bp, Artificial Sequence
  misc_feature (1)..(45): primer forward
ggaattccagctgaccaccatgcttttacaaggaatgcgtttatc

SEQ ID NO: 647 - DNA, 45 bp, Artificial Sequence
  misc_feature (1)..(45): primer forward
ggaattccagctgaccaccatgtccattgagaatctgaaatcatt

SEQ ID NO: 648 - DNA, 42 bp, Artificial Sequence
  misc_feature (1)..(42): primer forward
ggaattccagctgaccaccatgaccgtcgttatcggagtctt

SEQ ID NO: 649 - DNA, 45 bp, Artificial Sequence
  misc_feature (1)..(45): primer forward
ggaattccagctgaccaccatgaagattttaacccaagacgaaat

SEQ ID NO: 650 - DNA, 45 bp, Artificial Sequence
  misc_feature (1)..(45): primer forward
ggaattccagctgaccaccatgtcgcatactttaaaatcgaaaac

SEQ ID NO: 651 - DNA, 47 bp, Artificial Sequence
  misc_feature (1)..(47): primer forward
ggaattccagctgaccaccatgtcttttagaaagaaaaaactcaaac

SEQ ID NO: 652 - DNA, 44 bp, Artificial Sequence
  misc_feature (1)..(44): primer forward
ggaattccagctgaccaccatgagctctgacgaagaagatttca

SEQ ID NO: 653 - DNA, 43 bp, Artificial Sequence
  misc_feature (1)..(43): primer forward
ggaattccagctgaccaccatgtccacccttttgaagtctgct

SEQ ID NO: 654 - DNA, 43 bp, Artificial Sequence
  misc_feature (1)..(43): primer forward
ggaattccagctgaccaccatggcaagtaaccagcacatagga

SEQ ID NO: 655 - DNA, 45 bp, Artificial Sequence
  misc_feature (1)..(45): primer forward
ggaattccagctgaccaccatgataaaaaactatttgggacgaag

SEQ ID NO: 656 - DNA, 45 bp, Artificial Sequence
  misc_feature (1)..(45): primer forward
ggaattccagctgaccaccatgatatcaccatcaaaaaagagaac

SEQ ID NO: 657 - DNA, 41 bp, Artificial Sequence
  misc_feature (1)..(41): primer forward
ggaattccagctgaccaccatgatgccctacaacacccctc

SEQ ID NO: 658 - DNA, 43 bp, Artificial Sequence
  misc_feature (1)..(43): primer forward
ggaattccagctgaccaccatgaaactggcgcaagacatgaat

SEQ ID NO: 659 - DNA, 44 bp, Artificial Sequence
  misc_feature (1)..(44): primer forward
ggaattccagctgaccaccatggaggtaacttcaatgtttctca

SEQ ID NO: 660 - DNA, 47 bp, Artificial Sequence
  misc_feature (1)..(47): primer forward
ggaattccagctgaccaccatgactacaaataatgacttctattttg

SEQ ID NO: 661 - DNA, 45 bp, Artificial Sequence
  misc_feature (1)..(45): primer forward
ggaattccagctgaccaccatgtctggttatttttcagggttttc

SEQ ID NO: 662 - DNA, 44 bp, Artificial Sequence
  misc_feature (1)..(44): primer forward
ggaattccagctgaccaccatggctgaaatgaagaattcgacag

SEQ ID NO: 663 - DNA, 44 bp, Artificial Sequence
  misc_feature (1)..(44): primer forward
ggaattccagctgaccaccatgcgcgtttttactttgattgcga

SEQ ID NO: 664 - DNA, 45 bp, Artificial Sequence
  misc_feature (1)..(45): primer forward
ggaattccagctgaccaccatgggtaaatcgtatgtccatataac

SEQ ID NO: 665 - DNA, 45 bp, Artificial Sequence
  misc_feature (1)..(45): primer forward
ggaattccagctgaccaccatgtcaattcaggcttttgtcttttg

SEQ ID NO: 666 - DNA, 44 bp, Artificial Sequence
  misc_feature (1)..(44): primer forward
ggaattccagctgaccaccatgtccaccctttttctgattggaa

SEQ ID NO: 667 - DNA, 42 bp, Artificial Sequence
  misc_feature (1)..(42): primer forward
ggaattccagctgaccaccatggcaggtcattcacacaggtc

SEQ ID NO: 668 - DNA, 44 bp, Artificial Sequence
  misc_feature (1)..(44): primer forward
ggaattccagctgaccaccatggtagtacaaaatagcccagttt

SEQ ID NO: 669 - DNA, 46 bp, Artificial Sequence
  misc_feature (1)..(46): primer forward
ggaattccagctgaccaccatgaaagaaagcaaaaaaatggctaaa

SEQ ID NO: 670 - DNA, 45 bp, Artificial Sequence
  misc_feature (1)..(45): primer forward
ggaattccagctgaccaccatgaaagcaaccattcaaagagtaac

SEQ ID NO: 671 - DNA, 42 bp, Artificial Sequence
  misc_feature (1)..(42): primer forward
ggaattccagctgaccaccatggtcaccccaagagaacctaa

SEQ ID NO: 672 - DNA, 43 bp, Artificial Sequence
  misc_feature (1)..(43): primer forward
ggaattccagctgaccaccatgaatcagagcgatagcagcttg

SEQ ID NO: 673 - DNA, 45 bp, Artificial Sequence
  misc_feature (1)..(45): primer forward
ggaattccagctgaccaccatgtcgtatgtttgatcttaaccatt

SEQ ID NO: 674 - DNA, 44 bp, Artificial Sequence
  misc_feature (1)..(44): primer forward
ggaattccagctgaccaccatgaatgattggcatgagttcaatg

SEQ ID NO: 675 - DNA, 42 bp, Artificial Sequence
  misc_feature (1)..(42): primer forward
ggaattccagctgaccaccatggatagaggcaggtggtgttt

SEQ ID NO: 676 - DNA, 44 bp, Artificial Sequence
  misc_feature (1)..(44): primer forward
ggaattccagctgaccaccatgaaacagatagtcaaaagaagcc

SEQ ID NO: 677 - DNA, 43 bp, Artificial Sequence
  misc_feature (1)..(43): primer forward
ggaattccagctgaccaccatgggcacactgtttcgaagaaat

SEQ ID NO: 678 - DNA, 44 bp, Artificial Sequence
  misc_feature (1)..(44): primer forward
ggaattccagctgaccaccatggaacagaacaggttcaagaaag

SEQ ID NO: 679 - DNA, 45 bp, Artificial Sequence
  misc_feature (1)..(45): primer forward
ggaattccagctgaccaccatgtcatctcagtttttcctgaaaac

SEQ ID NO: 680 - DNA, 43 bp, Artificial Sequence
  misc_feature (1)..(43): primer forward
ggaattccagctgaccaccatgtcagccaccagagccaataaa

SEQ ID NO: 681 - DNA, 47 bp, Artificial Sequence
  misc_feature (1)..(47): primer forward
ggaattccagctgaccaccatgtattcaattgttaaagagattattg

SEQ ID NO: 682 - DNA, 42 bp, Artificial Sequence
  misc_feature (1)..(42): primer forward
ggaattccagctgaccaccatgaaggcgtcgcacatttgctc

SEQ ID NO: 683 - DNA, 44 bp, Artificial Sequence
  misc_feature (1)..(44): primer forward
ggaattccagctgaccaccatggatatggtatcaccagtcttga

SEQ ID NO: 684 - DNA, 36 bp, Artificial Sequence
  misc_feature (1)..(36): primer forward
ttgctcttccatgaaacatctgcatcgattctttag

SEQ ID NO: 685 - DNA, 33 bp, Artificial Sequence
  misc_feature (1)..(33): primer forward
ttgctcttccatgagtgcgttaaataagaaaag

SEQ ID NO: 686 - DNA, 33 bp, Artificial Sequence
  misc_feature (1)..(33): primer forward
ttgctcttccatggaaacgactcaaaccagcac

SEQ ID NO: 687 - DNA, 35 bp, Artificial Sequence
  misc_feature (1)..(35): primer forward
ttgctcttccatgtttcattgtcctttatgccagc

SEQ ID NO: 688 - DNA, 34 bp, Artificial Sequence
  misc_feature (1)..(34): primer forward
ttgctcttccatggcaattaacaatacaggctcg

SEQ ID NO: 689 - DNA, 36 bp, Artificial Sequence
  misc_feature (1)..(36): primer forward
ttgctcttccatgagtacttcagatagcattgtatc

SEQ ID NO: 690 - DNA, 34 bp, Artificial Sequence
  misc_feature (1)..(34): primer forward
ttgctcttccatgaacatgttttttaggcttacc

SEQ ID NO: 691 - DNA, 37 bp, Artificial Sequence
  misc_feature (1)..(37): primer forward
ttgctcttccatgttcatggcaacttatatgactttt

SEQ ID NO: 692 - DNA, 32 bp, Artificial Sequence
  misc_feature (1)..(32): primer forward
ttgctcttccatgatcaggagtcacaccatga

SEQ ID NO: 693 - DNA, 35 bp, Artificial Sequence
  misc_feature (1)..(35): primer forward
ttgctcttccatgatggctaacagaatgattctga

SEQ ID NO: 694 - DNA, 32 bp, Artificial Sequence
  misc_feature (1)..(32): primer forward
ttgctcttccatgaattatcgctatcgcgcca

SEQ ID NO: 695 - DNA, 35 bp, Artificial Sequence
  misc_feature (1)..(35): primer forward
ttgctcttccatggatcgtattgttagttcttcac

SEQ ID NO: 696 - DNA, 43 bp, Artificial Sequence
  misc_feature (1)..(43): primer forward
ggaattccagctgaccaccatgtccaacaagctgttcaggtta

SEQ ID NO: 697 - DNA, 44 bp, Artificial Sequence
  misc_feature (1)..(44): primer forward
ggaattccagctgaccaccatggtagcaacaataatgcagacga

SEQ ID NO: 698 - DNA, 42 bp, Artificial Sequence
  misc_feature (1)..(42): primer forward
ggaattccagctgaccaccatgaatccgggcggtgaacaaac

SEQ ID NO: 699 - DNA, 45 bp, Artificial Sequence
  misc_feature (1)..(45): primer forward
ggaattccagctgaccaccatggacaaaatcagagaaaagctaag

SEQ ID NO: 700 - DNA, 43 bp, Artificial Sequence
  misc_feature (1)..(43): primer forward
ggaattccagctgaccaccatggcaggtatcaagttgacgcat

SEQ ID NO: 701 - DNA, 45 bp, Artificial Sequence
  misc_feature (1)..(45): primer forward
ggaattccagctgaccaccatgtgtgaatcatcaaataagactga

SEQ ID NO: 702 - DNA, 43 bp, Artificial Sequence
  misc_feature (1)..(43): primer forward
ggaattccagctgaccaccatggaggaacaacgtgaaatactg

SEQ ID NO: 703 - DNA, 43 bp, Artificial Sequence
  misc_feature (1)..(43): primer forward
ggaattccagctgaccaccatgtctgaaaaggccgttagaagg

SEQ ID NO: 704 - DNA, 41 bp, Artificial Sequence
  misc_feature (1)..(41): primer forward
ggaattccagctgaccaccatgatcgctacctccagagccg

SEQ ID NO: 705 - DNA, 41 bp, Artificial Sequence
  misc_feature (1)..(41): primer forward
ggaattccagctgaccaccatggcctcctcaagtagcacgc

SEQ ID NO: 706 - DNA, 45 bp, Artificial Sequence
  misc_feature (1)..(45): primer reverse
gatccccgggaattgccatgttacacatcattgcaagctgattgt

SEQ ID NO: 707 - DNA, 46 bp, Artificial Sequence
  misc_feature (1)..(46): primer reverse
gatccccgggaattgccatgttatagagaaggagacattgaaacat

SEQ ID NO: 708 - DNA, 43 bp, Artificial Sequence
  misc_feature (1)..(43): primer reverse
gatccccgggaattgccatgtcaaacttcgttccaacccaggg

SEQ ID NO: 709 - DNA, 46 bp, Artificial Sequence
  misc_feature (1)..(46): primer reverse
gatccccgggaattgccatgtcaattgcagggattatggaataaaa

SEQ ID NO: 710 - DNA, 44 bp, Artificial Sequence
  misc_feature (1)..(44): primer reverse
gatccccgggaattgccatgttagaactgaacagaacccatggc

SEQ ID NO: 711 - DNA, 46 bp, Artificial Sequence
  misc_feature (1)..(46): primer reverse
gatccccgggaattgccatgttattgtgaatgtgagttatgcgaag

SEQ ID NO: 712 - DNA, 45 bp, Artificial Sequence
  misc_feature (1)..(45): primer reverse
gatccccgggaattgccatgttactttgatcccttcgattctgca

SEQ ID NO: 713 - DNA, 42 bp, Artificial Sequence
  misc_feature (1)..(42): primer reverse
gatccccgggaattgccatgtcatgatgatgccggacccttc

SEQ ID NO: 714 - DNA, 46 bp, Artificial Sequence
  misc_feature (1)..(46): primer reverse
gatccccgggaattgccatgctacattttcatggtttcttcaactc

SEQ ID NO: 715 - DNA, 46 bp, Artificial Sequence
  misc_feature (1)..(46): primer reverse
gatccccgggaattgccatgtcatccaataaagctaacacttgttc

SEQ ID NO: 716 - DNA, 46 bp, Artificial Sequence
  misc_feature (1)..(46): primer reverse
gatccccgggaattgccatgctatggttcgctattcaatattagaa

SEQ ID NO: 717 - DNA, 44 bp, Artificial Sequence
  misc_feature (1)..(44): primer reverse
gatccccgggaattgccatgttacaacaataaagcggcagcacc

SEQ ID NO: 718 - DNA, 41 bp, Artificial Sequence
  misc_feature (1)..(41): primer reverse
gatccccgggaattgccatgtcaacagcagcccccaccggt

SEQ ID NO: 719 - DNA, 45 bp, Artificial Sequence
  misc_feature (1)..(45): primer reverse
gatccccgggaattgccatgttaaggaagcgcatctacatcttct

SEQ ID NO: 720 - DNA, 44 bp, Artificial Sequence
  misc_feature (1)..(44): primer reverse
gatccccgggaattgccatgtcaaccatacctttgatccaactg

SEQ ID NO: 721 - DNA, 44 bp, Artificial Sequence
  misc_feature (1)..(44): primer reverse
gatccccgggaattgccatgtcaattcttaccagcaccagctct

SEQ ID NO: 722 - DNA, 46 bp, Artificial Sequence
  misc_feature (1)..(46): primer reverse
gatccccgggaattgccatgttactgtagagcatgttggaaatatt

SEQ ID NO: 723 - DNA, 45 bp, Artificial Sequence
  misc_feature (1)..(45): primer reverse
gatccccgggaattgccatgttatatatggcatgtcttcgcatgt

SEQ ID NO: 724 - DNA, 45 bp, Artificial Sequence
  misc_feature (1)..(45): primer reverse
gatccccgggaattgccatgtcagacccttttgccaagtttgtaa

SEQ ID NO: 725 - DNA, 46 bp, Artificial Sequence
  misc_feature (1)..(46): primer reverse
gatccccgggaattgccatgttactcaccattaaaacatctttccc

SEQ ID NO: 726 - DNA, 48 bp, Artificial Sequence
  misc_feature (1)..(48): primer reverse
gatccccgggaattgccatgttagttgctattatcaaaataaaaagac

SEQ ID NO: 727 - DNA, 48 bp, Artificial Sequence
  misc_feature (1)..(48): primer reverse
gatccccgggaattgccatgtcaaaaaaaaaaaggaaaaagagaaaag

SEQ ID NO: 728 - DNA, 47 bp, Artificial Sequence
  misc_feature (1)..(47): primer reverse
gatccccgggaattgccatgtcacatttttctaaattcacttagcac

SEQ ID NO: 729 - DNA, 45 bp, Artificial Sequence
  misc_feature (1)..(45): primer reverse
gatccccgggaattgccatgttagtatgtaggcttagtaacccaa

SEQ ID NO: 730 - DNA, 45 bp, Artificial Sequence
  misc_feature (1)..(45): primer reverse
gatccccgggaattgccatgtcaaccctcaaaatttgctttatcg

SEQ ID NO: 731 - DNA, 46 bp, Artificial Sequence
  misc_feature (1)..(46): primer reverse
gatccccgggaattgccatgctattgaaataccggcttcaatattt

SEQ ID NO: 732 - DNA, 43 bp, Artificial Sequence
  misc_feature (1)..(43): primer reverse
gatccccgggaattgccatgctaggaaaggaggtggttacgaa

SEQ ID NO: 733 - DNA, 45 bp, Artificial Sequence
  misc_feature (1)..(45): primer reverse
gatccccgggaattgccatgttagattgcaaaatgagcctgacga

SEQ ID NO: 734 - DNA, 43 bp, Artificial Sequence
  misc_feature (1)..(43): primer reverse
gatccccgggaattgccatgctaaatctggtagacttgctggc

SEQ ID NO: 735 - DNA, 45 bp, Artificial Sequence
  misc_feature (1)..(45): primer reverse
gatccccgggaattgccatgttatccacgctccttataacatgaa

SEQ ID NO: 736 - DNA, 45 bp, Artificial Sequence
  misc_feature (1)..(45): primer reverse
gatccccgggaattgccatgttacgtacttccatttgcttcctct

SEQ ID NO: 737 - DNA, 50 bp, Artificial Sequence
  misc_feature (1)..(50): primer reverse
gatccccgggaattgccatgtcagttcatcaaaattgaaatttctaacca

SEQ ID NO: 738 - DNA, 45 bp, Artificial Sequence
  misc_feature (1)..(45): primer reverse
gatccccgggaattgccatgtcagttgggaattaggataatatcc

SEQ ID NO: 739 - DNA, 46 bp, Artificial Sequence
  misc_feature (1)..(46): primer reverse
gatccccgggaattgccatgtcagttacgttttcttttcagtttgt

SEQ ID NO: 740 - DNA, 45 bp, Artificial Sequence
  misc_feature (1)..(45): primer reverse
gatccccgggaattgccatgttacctattggcaggatcttcttga

SEQ ID NO: 741 - DNA, 48 bp, Artificial Sequence
  misc_feature (1)..(48): primer reverse
gatccccgggaattgccatgttacaatttgaatttaaaccttttttcc

SEQ ID NO: 742 - DNA, 45 bp, Artificial Sequence
  misc_feature (1)..(45): primer reverse
gatccccgggaattgccatgctacatgttaagttcttgttcctcc

SEQ ID NO: 743 - DNA, 46 bp, Artificial Sequence
  misc_feature (1)..(46): primer reverse
gatccccgggaattgccatgttatatactcaatccaaaacagggaa

SEQ ID NO: 744 - DNA, 45 bp, Artificial Sequence
  misc_feature (1)..(45): primer reverse
gatccccgggaattgccatgtcatacgactacttgaatagattcg

SEQ ID NO: 745 - DNA, 45 bp, Artificial Sequence
  misc_feature (1)..(45): primer reverse
gatccccgggaattgccatgttaattatggcctaaaactctcgac

SEQ ID NO: 746 - DNA, 45 bp, Artificial Sequence
  misc_feature (1)..(45): primer reverse
gatccccgggaattgccatgttagtcattgttgtaagtgttctgc

SEQ ID NO: 747 - DNA, 45 bp, Artificial Sequence
  misc_feature (1)..(45): primer reverse
gatccccgggaattgccatgttacaaataatcgtcaatgttgggg

SEQ ID NO: 748 - DNA, 45 bp, Artificial Sequence
  misc_feature (1)..(45): primer reverse
gatccccgggaattgccatgctaaataaactgtcccctgattctt

SEQ ID NO: 749 - DNA, 44 bp, Artificial Sequence
  misc_feature (1)..(44): primer reverse
gatccccgggaattgccatgctatactggcaagtgacagttgtg

SEQ ID NO: 750 - DNA, 47 bp, Artificial Sequence
  misc_feature (1)..(47): primer reverse
gatccccgggaattgccatgttaatcgaaaattctatgaaaaaaccc

SEQ ID NO: 751 - DNA, 44 bp, Artificial Sequence
  misc_feature (1)..(44): primer reverse
gatccccgggaattgccatgtcagaaacgctccactttacttcg

SEQ ID NO: 752 - DNA, 46 bp, Artificial Sequence
  misc_feature (1)..(46): primer reverse
gatccccgggaattgccatgttactcgctcttttttgagttacatg

SEQ ID NO: 753 - DNA, 44 bp, Artificial Sequence
  misc_feature (1)..(44): primer reverse
gatccccgggaattgccatgctaattcctgatgccaagtaacga

SEQ ID NO: 754 - DNA, 47 bp, Artificial Sequence
  misc_feature (1)..(47): primer reverse
gatccccgggaattgccatgttagtggaaaaacttcttcatcttttc

SEQ ID NO: 755 - DNA, 46 bp, Artificial Sequence
  misc_feature (1)..(46): primer reverse
gatccccgggaattgccatgttagtatctaaatggttgagagtatg

SEQ ID NO: 756 - DNA, 40 bp, Artificial Sequence
  misc_feature (1)..(40): primer reverse
gatccccgggaattgccatgctactcgccccccagcagag

SEQ ID NO: 757 - DNA, 46 bp, Artificial Sequence
  misc_feature (1)..(46): primer reverse
gatccccgggaattgccatgttagaaggtcgagttcaaaatattct

SEQ ID NO: 758 - DNA, 46 bp, Artificial Sequence
  misc_feature (1)..(46): primer reverse
gatccccgggaattgccatgttaagcgtattcgttaacattaacga

SEQ ID NO: 759 - DNA, 46 bp, Artificial Sequence
  misc_feature (1)..(46): primer reverse
gatccccgggaattgccatgttagacaacaatttcagattctatgg

SEQ ID NO: 760 - DNA, 42 bp, Artificial Sequence
  misc_feature (1)..(42): primer reverse
gatccccgggaattgccatgttaatggcaggcgagggagctg

SEQ ID NO: 761 - DNA, 49 bp, Artificial Sequence
  misc_feature (1)..(49): primer reverse
gatccccgggaattgccatgctagtataaatttaagtaatctttcatat

SEQ ID NO: 762 - DNA, 43 bp, Artificial Sequence
  misc_feature (1)..(43): primer reverse
gatccccgggaattgccatgttattgccccgttgcccattgtg

SEQ ID NO: 763 - DNA, 47 bp, Artificial Sequence
  misc_feature (1)..(47): primer reverse
gatccccgggaattgccatgttagaagtcatcatcaaagttaatttc

SEQ ID NO: 764 - DNA, 47 bp, Artificial Sequence
  misc_feature (1)..(47): primer reverse
gatccccgggaattgccatgttaattcttcatcaatgcctttagatt

SEQ ID NO: 765 - DNA, 46 bp, Artificial Sequence
  misc_feature (1)..(46): primer reverse
gatccccgggaattgccatgttatagttgttcatattcatcagggt

SEQ ID NO: 766 - DNA, 45 bp, Artificial Sequence
  misc_feature (1)..(45): primer reverse
gatccccgggaattgccatgtcaattccttttttttggaggaggt

SEQ ID NO: 767 - DNA, 41 bp, Artificial Sequence
  misc_feature (1)..(41): primer reverse
gatccccgggaattgccatgtcacgcagacatgcgactgcg

SEQ ID NO: 768 - DNA, 48 bp, Artificial Sequence
  misc_feature (1)..(48): primer reverse
gatccccgggaattgccatgttacatttcattcattttttttctctga

SEQ ID NO: 769 - DNA, 42 bp, Artificial Sequence
  misc_feature (1)..(42): primer reverse
gatccccgggaattgccatgctaagtacggccggaagagagc

SEQ ID NO: 770 - DNA, 44 bp, Artificial Sequence
  misc_feature (1)..(44): primer reverse
gatccccgggaattgccatgttacacagtttccaagacttcgtc

SEQ ID NO: 771 - DNA, 44 bp, Artificial Sequence
  misc_feature (1)..(44): primer reverse
gatccccgggaattgccatgctacttccaaacaactggtccaga

SEQ ID NO: 772 - DNA, 46 bp, Artificial Sequence
  misc_feature (1)..(46): primer reverse
gatccccgggaattgccatgttatactaatttatgatcaccgtcgg

SEQ ID NO: 773 - DNA, 45 bp, Artificial Sequence
  misc_feature (1)..(45): primer reverse
gatccccgggaattgccatgttattttctgtatctccacaaggac

SEQ ID NO: 774 - DNA, 45 bp, Artificial Sequence
  misc_feature (1)..(45): primer reverse
gatccccgggaattgccatgctaggcaaatgccaaagatttctta

SEQ ID NO: 775 - DNA, 44 bp, Artificial Sequence
  misc_feature (1)..(44): primer reverse
gatccccgggaattgccatgctagtctctatttcttccgggaac

SEQ ID NO: 776 - DNA, 44 bp, Artificial Sequence
  misc_feature (1)..(44): primer reverse
gatccccgggaattgccatgctagtcctttttcgagctccagaa

SEQ ID NO: 777 - DNA, 45 bp, Artificial Sequence
  misc_feature (1)..(45): primer reverse
gatccccgggaattgccatgctaagtttcattctcactatcactg

SEQ ID NO: 778 - DNA, 45 bp, Artificial Sequence
  misc_feature (1)..(45): primer reverse
gatccccgggaattgccatgctacattctcattgtggtttctaag

SEQ ID NO: 779 - DNA, 48 bp, Artificial Sequence
  misc_feature (1)..(48): primer reverse
gatccccgggaattgccatgttaatcataaatagtttcataagtgtgt

SEQ ID NO: 780 - DNA, 46 bp, Artificial Sequence
  misc_feature (1)..(46): primer reverse
gatccccgggaattgccatgtcacttcctatgcaaaatgcttaata

SEQ ID NO: 781 - DNA, 42 bp, Artificial Sequence
  misc_feature (1)..(42): primer reverse
gatccccgggaattgccatgtcagtcatggcatgccttggca

SEQ ID NO: 782 - DNA, 45 bp, Artificial Sequence
  misc_feature (1)..(45): primer reverse
gatccccgggaattgccatgctaaaatgaagacagccacaatctg

SEQ ID NO: 783 - DNA, 45 bp, Artificial Sequence
  misc_feature (1)..(45): primer reverse
gatccccgggaattgccatgctattgattgtttgttccacggact

SEQ ID NO: 784 - DNA, 45 bp, Artificial Sequence
  misc_feature (1)..(45): primer reverse
gatccccgggaattgccatgttatgaagtccatggtaaattcgtg

SEQ ID NO: 785 - DNA, 46 bp, Artificial Sequence
  misc_feature (1)..(46): primer reverse
gatccccgggaattgccatgttacatgaggttcatgttcatgttag

SEQ ID NO: 786 - DNA, 49 bp, Artificial Sequence
  misc_feature (1)..(49): primer reverse
gatccccgggaattgccatgttattttttacttaatttcatccatttag

SEQ ID NO: 787 - DNA, 48 bp, Artificial Sequence
  misc_feature (1)..(48): primer reverse
gatccccgggaattgccatgttatgtatcacaactattaaattcagtt

SEQ ID NO: 788 - DNA, 46 bp, Artificial Sequence
  misc_feature (1)..(46): primer reverse
gatccccgggaattgccatgttaatctctttcaaaacagacagcaa

SEQ ID NO: 789 - DNA, 44 bp, Artificial Sequence
  misc_feature (1)..(44): primer reverse
gatccccgggaattgccatgctatttttcactttggctgttgcc

SEQ ID NO: 790 - DNA, 44 bp, Artificial Sequence
  misc_feature (1)..(44): primer reverse
gatccccgggaattgccatgttaactctcttgtcccgatttctc

SEQ ID NO: 791 - DNA, 46 bp, Artificial Sequence
  misc_feature (1)..(46): primer reverse
gatccccgggaattgccatgttagtttctcaagtgactattgtgaa

SEQ ID NO: 792 - DNA, 44 bp, Artificial Sequence
  misc_feature (1)..(44): primer reverse
gatccccgggaattgccatgttacgaatcagtccgattggactt

SEQ ID NO: 793 - DNA, 44 bp, Artificial Sequence
  misc_feature (1)..(44): primer reverse
gatccccgggaattgccatgttaagctggaagagccaatctctt

SEQ ID NO: 794 - DNA, 48 bp, Artificial Sequence
  misc_feature (1)..(48): primer reverse
gatccccgggaattgccatgttatttcaaagtcttcaacaatttttct

SEQ ID NO: 795 - DNA, 45 bp, Artificial Sequence
  misc_feature (1)..(45): primer reverse
gatccccgggaattgccatgttagtcttcatgcttatcacagaac

SEQ ID NO: 796 - DNA, 45 bp, Artificial Sequence
  misc_feature (1)..(45): primer reverse
gatccccgggaattgccatgtcacttcaaagtctctggaatatga

SEQ ID NO: 797 - DNA, 46 bp, Artificial Sequence
  misc_feature (1)..(46): primer reverse
gatccccgggaattgccatgttattcgtcttcttccaaagtttgag

SEQ ID NO: 798 - DNA, 44 bp, Artificial Sequence
  misc_feature (1)..(44): primer reverse
gatccccgggaattgccatgctatgagcgatcccgttttgtgaa

SEQ ID NO: 799 - DNA, 50 bp, Artificial Sequence
  misc_feature (1)..(50): primer reverse
gatccccgggaattgccatgttaataattgaatttaattttacttctgtt

SEQ ID NO: 800 - DNA, 45 bp, Artificial Sequence
  misc_feature (1)..(45): primer reverse
gatccccgggaattgccatgtcaccgactcattttgttaagcttg

SEQ ID NO: 801 - DNA, 45 bp, Artificial Sequence
  misc_feature (1)..(45): primer reverse
gatccccgggaattgccatgttactcatcttcatagacgtggaag

SEQ ID NO: 802 - DNA, 48 bp, Artificial Sequence
  misc_feature (1)..(48): primer reverse
gatccccgggaattgccatgctaacatttcttattatctctatatatc

SEQ ID NO: 803 - DNA, 45 bp, Artificial Sequence
  misc_feature (1)..(45): primer reverse
gatccccgggaattgccatgctaactgcttttttcgtgttgagta

SEQ ID NO: 804 - DNA, 48 bp, Artificial Sequence
  misc_feature (1)..(48): primer reverse
gatccccgggaattgccatgtcatttttgtccctttatatcaattttt

SEQ ID NO: 805 - DNA, 45 bp, Artificial Sequence
  misc_feature (1)..(45): primer reverse
gatccccgggaattgccatgttagcgtttttttttgcccttcttc

SEQ ID NO: 806 - DNA, 47 bp, Artificial Sequence
  misc_feature (1)..(47): primer reverse
gatccccgggaattgccatgctaaatttccaaaccatttagaacttt

SEQ ID NO: 807 - DNA, 47 bp, Artificial Sequence
  misc_feature (1)..(47): primer reverse
gatccccgggaattgccatgctaagacttgaaattaattaattcggg

SEQ ID NO: 808 - DNA, 44 bp, Artificial Sequence
  misc_feature (1)..(44): primer reverse
gatccccgggaattgccatgtcactgtatctcgctgtcacaatc

SEQ ID NO: 809 - DNA, 46 bp, Artificial Sequence
  misc_feature (1)..(46): primer reverse
gatccccgggaattgccatgctattgtaattcccttatagtgttca

SEQ ID NO: 810 - DNA, 46 bp, Artificial Sequence
  misc_feature (1)..(46): primer reverse
gatccccgggaattgccatgttatttaagctcgaaatggctattga

SEQ ID NO: 811 - DNA, 44 bp, Artificial Sequence
  misc_feature (1)..(44): primer reverse
gatccccgggaattgccatgtcattgtggaagaggtcttctagg

SEQ ID NO: 812 - DNA, 45 bp, Artificial Sequence
  misc_feature (1)..(45): primer reverse
gatccccgggaattgccatgttacataccattccaaggtaacgaa

SEQ ID NO: 813 - DNA, 44 bp, Artificial Sequence
  misc_feature (1)..(44): primer reverse
gatccccgggaattgccatgctatatattgaagccgctgaggtc

SEQ ID NO: 814 - DNA, 46 bp, Artificial Sequence
  misc_feature (1)..(46): primer reverse
gatccccgggaattgccatgctacttacgtactaaaatagtctctt

SEQ ID NO: 815 - DNA, 45 bp, Artificial Sequence
  misc_feature (1)..(45): primer reverse
gatccccgggaattgccatgttactgagccagtaaatacgttcct

SEQ ID NO: 816 - DNA, 45 bp, Artificial Sequence
  misc_feature (1)..(45): primer reverse
gatccccgggaattgccatgctaagccaaagtggcgttatataac

SEQ ID NO: 817 - DNA, 45 bp, Artificial Sequence
  misc_feature (1)..(45): primer reverse
gatccccgggaattgccatgtcatcttcgaagataaggggtattc

SEQ ID NO: 818 - DNA, 45 bp, Artificial Sequence
  misc_feature (1)..(45): primer reverse
gatccccgggaattgccatgttactcaacaggggtttttaacaca

SEQ ID NO: 819 - DNA, 45 bp, Artificial Sequence
  misc_feature (1)..(45): primer reverse
gatccccgggaattgccatgttattttggtatcacatcatcggag

SEQ ID NO: 820 - DNA, 44 bp, Artificial Sequence
  misc_feature (1)..(44): primer reverse
gatccccgggaattgccatgtcaatttgctataggctgtagcgg

SEQ ID NO: 821 - DNA, 47 bp, Artificial Sequence
  misc_feature (1)..(47): primer reverse
gatccccgggaattgccatgttagaactgaattatttcacattgtct

SEQ ID NO: 822 - DNA, 44 bp, Artificial Sequence
  misc_feature (1)..(44): primer reverse
gatccccgggaattgccatgttacattgggaagggcatctgaga

SEQ ID NO: 823 - DNA, 47 bp, Artificial Sequence
  misc_feature (1)..(47): primer reverse
gatccccgggaattgccatgttacagtttttgtttagtcgttttaac

SEQ ID NO: 824 - DNA, 45 bp, Artificial Sequence
  misc_feature (1)..(45): primer reverse
gatccccgggaattgccatgttattcatccttccaacccaacttt

SEQ ID NO: 825 - DNA, 45 bp, Artificial Sequence
  misc_feature (1)..(45): primer reverse
gatccccgggaattgccatgtcattgtctcaaaacatcttcgatg

SEQ ID NO: 826 - DNA, 47 bp, Artificial Sequence
  misc_feature (1)..(47): primer reverse
gatccccgggaattgccatgttatttttcatcagatactgataaggt

SEQ ID NO: 827 - DNA, 43 bp, Artificial Sequence
  misc_feature (1)..(43): primer reverse
gatccccgggaattgccatgtcaatgctcatccatgagcgcca

SEQ ID NO: 828 - DNA, 46 bp, Artificial Sequence
  misc_feature (1)..(46): primer reverse
gatccccgggaattgccatgctaaaatatggaggaactaggtttaa

SEQ ID NO: 829 - DNA, 35 bp, Artificial Sequence
  misc_feature (1)..(35): primer reverse
ttgctcttcgttaaactgatggacgcaaacgaacg

SEQ ID NO: 830 - DNA, 36 bp, Artificial Sequence
  misc_feature (1)..(36): primer reverse
ttgctcttcgttatttcttacgcgcgtatttcagtg

SEQ ID NO: 831 - DNA, 35 bp, Artificial Sequence
  misc_feature (1)..(35): primer reverse
ttgctcttcgttagctgaacagagagtagaagatt

SEQ ID NO: 832 - DNA, 34 bp, Artificial Sequence
  misc_feature (1)..(34): primer reverse
ttgctcttcgttacatccacataatttgctgccc

SEQ ID NO: 833 - DNA, 33 bp, Artificial Sequence
  misc_feature (1)..(33): primer reverse
ttgctcttcgttacttcacatcatccggcagcg

SEQ ID NO: 834 - DNA, 37 bp, Artificial Sequence
  misc_feature (1)..(37): primer reverse
ttgctcttcgttaaaacagtttgtatacgatgttcag

SEQ ID NO: 835 - DNA, 32 bp, Artificial Sequence
  misc_feature (1)..(32): primer reverse
ttgctcttcgttacttgacgggagcgggttgt

SEQ ID NO: 836 - DNA, 34 bp, Artificial Sequence
  misc_feature (1)..(34): primer reverse
ttgctcttcgttaactcgccgtttcaggcttaaa

SEQ ID NO: 837 - DNA, 31 bp, Artificial Sequence
  misc_feature (1)..(31): primer reverse
ttgctcttcgttaattgccagccatcgcctg

SEQ ID NO: 838 - DNA, 33 bp, Artificial Sequence
  misc_feature (1)..(33): primer reverse
ttgctcttcgttaccaggcggtatggtaaagct

SEQ ID NO: 839 - DNA, 38 bp, Artificial Sequence
  misc_feature (1)..(38): primer reverse
ttgctcttcgttaattaatcattgagttaagttgaaga

SEQ ID NO: 840 - DNA, 32 bp, Artificial Sequence
  misc_feature (1)..(32): primer reverse
ttgctcttcgttaatcgcggctagcgaagccc

SEQ ID NO: 841 - DNA, 45 bp, Artificial Sequence
  misc_feature (1)..(45): primer reverse
gatccccgggaattgccatgctaatttggttccacaaaggctcta

SEQ ID NO: 842 - DNA, 44 bp, Artificial Sequence
  misc_feature (1)..(44): primer reverse
gatccccgggaattgccatgtcagtcgtattcttggagacagtc

SEQ ID NO: 843 - DNA, 45 bp, Artificial Sequence
  misc_feature (1)..(45): primer reverse
gatccccgggaattgccatgttagtcgtcgtagttttcatcttct

SEQ ID NO: 844 - DNA, 44 bp, Artificial Sequence
  misc_feature (1)..(44): primer reverse
gatccccgggaattgccatgtcacaagttttccagagatgcagc

SEQ ID NO: 845 - DNA, 48 bp, Artificial Sequence
  misc_feature (1)..(48): primer reverse
gatccccgggaattgccatgtcattttgttaatagttttttgtatgct

SEQ ID NO: 846 - DNA, 46 bp, Artificial Sequence
  misc_feature (1)..(46): primer reverse
gatccccgggaattgccatgttatttcttgggtataactgtcagtc

SEQ ID NO: 847 - DNA, 44 bp, Artificial Sequence
  misc_feature (1)..(44): primer reverse
gatccccgggaattgccatgtcacaactcgccgaattcatcgta

SEQ ID NO: 848 - DNA, 46 bp, Artificial Sequence
  misc_feature (1)..(46): primer reverse
gatccccgggaattgccatgttataaaattatgcaacagttagccc

SEQ ID NO: 849 - DNA, 46 bp, Artificial Sequence
  misc_feature (1)..(46): primer reverse
gatccccgggaattgccatgctatttcaatgaaccagtttggaatc

SEQ ID NO: 850 - DNA, 46 bp, Artificial Sequence
  misc_feature (1)..(46): primer reverse
gatccccgggaattgccatgctagttgtcgtattcttccttaatta

SEQ ID NO: 851 - DNA, 38 bp, Artificial Sequence
  misc_feature (1)..(38): Sequence contained in yeast cloning cassette
ggaattccagctgaccaccatggcaattcccggggatc

SEQ ID NO: 852 - DNA, 38 bp, Artificial Sequence
  misc_feature (1)..(38): Sequence contained in E. coli cloning cassette
ttgctcttccatggcaatgattaattaacgaagagcaa

---

The invention claimed is:

1. A transgenic plant cell with increased tolerance and/or resistance to drought and/or low temperature stress as compared to a corresponding non-transformed wild type plant cell, wherein the transgenic plant cell is transformed with a Stress-Related Protein (SRP) coding nucleic acid selected from the group consisting of:

a) a nucleic acid molecule encoding a polypeptide comprising the amino acid sequence of SEQ ID NO: 65, b) a nucleic acid molecule comprising the nucleotide sequence of SEQ ID NO: 64, c) a nucleic acid molecule encoding a polypeptide comprising an amino acid sequence having at least 95% sequence identity with the amino acid sequence of SEQ ID NO: 65 and conferring said increased tolerance and/or resistance to drought and/or low temperature stress in a plant cell, and d) a nucleic acid molecule comprising a nucleotide sequence having at least 95% sequence identity with the nucleotide sequence of SEQ ID NO: 64 and encoding a polypeptide conferring said increased tolerance and/or resistance to drought and/or low temperature stress in a plant cell, wherein the low temperature stress is below 15° C., and wherein expression of said SRP coding nucleic acid confers the increased tolerance and/or resistance to drought and/or low temperature stress to the plant cell.

2. The transgenic plant cell of claim 1 obtained from a monocotyledonous plant or from a dicotyledonous plant.

3. The transgenic plant cell of claim 1, obtained from a gymnosperm plant.

4. A transgenic plant generated from the plant cell of claim 1, wherein the transgenic plant is a monocotyledonous or dicotyledonous plant.

5. A transgenic plant generated from the plant cell of claim 1, wherein the transgenic plant is a gymnosperm plant.

6. A seed produced by the transgenic plant of claim 4, wherein the seed is genetically homozygous for a transgene conferring increased tolerance and/or resistance to drought and/or low temperature stress as compared to a corresponding non-transformed wild type plant.

7. A method of producing a transgenic plant with increased tolerance and/or resistance to drought and/or low temperature stress as compared to a corresponding non-transformed wild type plant, comprising
  a) transforming a plant cell with a vector comprising a Stress-Related Protein (SRP) coding nucleic acid selected from the group consisting of:
    i) a nucleic acid molecule encoding a polypeptide comprising the amino acid sequence of SEQ ID NO: 65,
    ii) a nucleic acid molecule comprising the nucleotide sequence of SEQ ID NO: 64,
    iii) a nucleic acid molecule encoding a polypeptide comprising an amino acid sequence having at least 95% sequence identity with the amino acid sequence of SEQ ID NO: 65 and conferring said increased tolerance and/or resistance to drought and/or low temperature stress in a plant cell, and
    iv) a nucleic acid molecule comprising a nucleotide sequence having at least 95% sequence identity with the nucleotide sequence of SEQ ID NO: 64 and encoding a polypeptide conferring said increased tolerance and/or resistance to drought and/or low temperature stress in a plant cell, and
  b) generating from the plant cell a transgenic plant with increased tolerance and/or resistance to drought and/or low temperature stress as compared to a corresponding non-transformed wild type plant,
  wherein the low temperature stress is below 15° C., and
  wherein expression of said SRP coding nucleic acid confers the increased tolerance and/or resistance to drought and/or low temperature stress to the plant.

8. A method of increasing drought and/or low temperature stress tolerance of a plant, comprising increasing the level of expression of an SRP in a plant by introducing a SRP coding nucleic acid into said plant, wherein the SRP coding nucleic acid is selected from the group consisting of:
  a) a nucleic acid molecule encoding a polypeptide comprising the amino acid sequence of SEQ ID NO: 65,
  b) a nucleic acid molecule comprising the nucleotide sequence of SEQ ID NO: 64,
  c) a nucleic acid molecule encoding a polypeptide comprising an amino acid sequence having at least 95% sequence identity with the amino acid sequence of SEQ ID NO: 65 and conferring said increased tolerance and/or resistance to drought and/or low temperature stress in a plant cell, and
  d) a nucleic acid molecule comprising a nucleotide sequence having at least 95% sequence identity with the nucleotide sequence of SEQ ID NO: 64 and encoding a polypeptide conferring said increased tolerance and/or resistance to drought and/or low temperature stress in a plant cell,
  wherein the low temperature stress is below 15° C., and
  wherein expression of said SRP coding nucleic acid confers the increased tolerance and/or resistance to drought and/or low temperature stress to the plant.

9. A plant cell comprising a nucleic acid construct which confers the expression of a nucleic acid molecule in a host cell, wherein the nucleic acid construct comprises the nucleic acid molecule and one or more regulatory elements, wherein the expression of the nucleic acid molecule in the host cell results in increased tolerance and/or resistance to drought and/or low temperature stress as compared to a corresponding non-transformed wild type host cell, wherein the low temperature stress is below 15° C., and wherein the nucleic acid molecule is selected from the group consisting of:
  a) a nucleic acid molecule encoding a polypeptide comprising the amino acid sequence of SEQ ID NO: 65,
  b) a nucleic acid molecule comprising the nucleotide sequence of SEQ ID NO: 64,
  c) a nucleic acid molecule encoding a polypeptide comprising an amino acid sequence having at least 95% sequence identity with the amino acid sequence of SEQ ID NO: 65 and conferring said increased tolerance and/or resistance to drought and/or low temperature stress in a plant cell, and
  d) a nucleic acid molecule comprising a nucleotide sequence having at least 95% sequence identity with the nucleotide sequence of SEQ ID NO: 64 and encoding a polypeptide conferring said increased tolerance and/or resistance to drought and/or low temperature stress in a plant cell.

10. A plant cell comprising a vector, wherein the vector comprises a nucleic acid molecule selected from the group consisting of:
  a) a nucleic acid molecule encoding a polypeptide comprising the amino acid sequence of SEQ ID NO: 65,
  b) a nucleic acid molecule comprising the nucleotide sequence of SEQ ID NO: 64,
  c) a nucleic acid molecule encoding a polypeptide comprising an amino acid sequence having at least 95% sequence identity with the amino acid sequence of SEQ ID NO: 65 and conferring increased tolerance and/or resistance to drought and/or low temperature stress in a plant cell, and
  d) a nucleic acid molecule comprising a nucleotide sequence having at least 95% sequence identity with the nucleotide sequence of SEQ ID NO: 64 and encoding a polypeptide conferring increased tolerance and/or resistance to drought and/or low temperature stress in a plant cell,
  wherein the low temperature stress is below 15° C.,
  and wherein expression of the nucleic acid molecule in the plant cell results in increased tolerance and/or resistance to drought and/or low temperature stress as compared to a corresponding non-transformed wild type host cell.

11. A plant comprising the plant cell of claim 10.

12. A plant comprising the plant cell of claim 9.

13. The method of claim 7, wherein the plant cell is obtained from a monocotyledonous plant or from a dicotyledonous plant.

14. The method of claim 7, wherein the plant cell is obtained from a gymnosperm plant.

15. A transgenic plant obtained from the method of claim 7.

16. A transgenic plant obtained from the method of claim 14.

17. A transgenic plant obtained from the method of claim 13.

18. The transgenic plant cell of claim 1, wherein the low temperature stress is below 4° C.

19. The method of claim 7, wherein the low temperature stress is below 4° C.

20. The transgenic plant cell of claim 1, or a transgenic plant generated from said transgenic plant cell, or a seed produced by said transgenic plant, wherein the Stress-Related Protein (SRP) coding nucleic acid comprises the nucleotide sequence of SEQ ID NO: 64 or encodes a polypeptide comprising the amino acid sequence of SEQ ID NO: 65, and wherein the seed is genetically homozygous for said SRP coding nucleic acid.

* * * * *